US011739160B2

(12) United States Patent
Beil et al.

(10) Patent No.: US 11,739,160 B2
(45) Date of Patent: Aug. 29, 2023

(54) PSEUDOFAB-BASED MULTISPECIFIC BINDING PROTEINS

(71) Applicant: SANOFI, Paris (FR)

(72) Inventors: Christian Beil, Frankfurt am Main (DE); Karl-Christian Engel, Frankfurt am Main (DE); Gerhard Hessler, Frankfurt am Main (DE); Soraya Hoelper, Frankfurt am Main (DE); Christian Lange, Frankfurt am Main (DE); Thomas Langer, Frankfurt am Main (DE); Cendrine Lemoine, Paris (FR); Wulf-Dirk Leuschner, Frankfurt am Main (DE); Sevim Ozgur Bruderle, Frankfurt am Main (DE); Ercole Rao, Frankfurt am Main (DE); Nadja Spindler, Frankfurt am Main (DE); Sandra Weil, Frankfurt am Main (DE)

(73) Assignee: SANOFI, Paris (FR)

( * ) Notice: Subject to any disclaimer, the term of this patent is extended or adjusted under 35 U.S.C. 154(b) by 225 days.

(21) Appl. No.: 16/725,224

(22) Filed: Dec. 23, 2019

(65) Prior Publication Data

US 2020/0255540 A1    Aug. 13, 2020

(30) Foreign Application Priority Data

Dec. 24, 2018  (EP) .................................. 18306840.2
Jun. 21, 2019  (EP) .................................. 19305813.8

(51) Int. Cl.
    *C07K 16/32*          (2006.01)
(52) U.S. Cl.
    CPC .......... *C07K 16/32* (2013.01); *C07K 2317/31* (2013.01); *C07K 2317/522* (2013.01); *C07K 2317/524* (2013.01); *C07K 2317/526* (2013.01); *C07K 2317/55* (2013.01)
(58) Field of Classification Search
    CPC ................ C07K 16/32; C07K 2317/31; C07K 2317/522; C07K 2317/524; C07K 2317/526; C07K 2317/55; C07K 16/244; C07K 16/2818; C07K 16/2878; C07K 2317/60; C07K 2317/92; C07K 16/468; C07K 2317/94; A61K 2039/505
    See application file for complete search history.

(56) References Cited

U.S. PATENT DOCUMENTS

| | | |
|---|---|---|
| 5,732,168 A | 3/1998 | Donald |
| 5,959,083 A | 9/1999 | Bosslet et al. |
| 6,833,441 B2 | 12/2004 | Wang et al. |
| 7,429,652 B2 | 9/2008 | Wang et al. |
| 7,612,181 B2 | 11/2009 | Wu et al. |
| 8,216,805 B2 | 7/2012 | Carter et al. |
| 8,258,268 B2 | 9/2012 | Wu et al. |
| 8,420,783 B2 | 4/2013 | Goldenberg et al. |
| 8,586,713 B2 | 11/2013 | Davis |
| 8,592,562 B2 | 11/2013 | Kannan et al. |
| 8,871,912 B2 | 10/2014 | Davis et al. |
| 9,067,986 B2 | 6/2015 | Gurney et al. |
| 9,150,663 B2 | 10/2015 | Labrijn et al. |
| 9,181,349 B2 | 11/2015 | Baurin et al. |
| 9,309,311 B2 | 4/2016 | Gurney et al. |
| 9,309,326 B2 | 4/2016 | Davis et al. |
| 9,499,634 B2 | 11/2016 | Dixit et al. |
| 9,505,848 B2 | 11/2016 | Davis et al. |
| 9,527,926 B2 | 12/2016 | Ho et al. |
| 9,527,927 B2 | 12/2016 | Chowdhury et al. |
| 9,562,109 B2 | 2/2017 | Von Kreudenstein et al. |
| 9,670,269 B2 | 6/2017 | Igawa et al. |
| 2002/0004587 A1 | 1/2002 | Miller et al. |
| 2010/0048877 A1 | 2/2010 | Ruker et al. |
| 2012/0184716 A1 | 7/2012 | Fischer et al. |
| 2013/0018174 A1 | 1/2013 | Igawa et al. |
| 2013/0317200 A1 | 11/2013 | Elson et al. |
| 2014/0051833 A1 | 2/2014 | Fischer et al. |
| 2014/0179547 A1 | 6/2014 | Fischer et al. |
| 2014/0378664 A1 | 12/2014 | Suh et al. |
| 2015/0094451 A1 | 4/2015 | Fischer et al. |
| 2015/0239991 A1 | 8/2015 | Belin et al. |
| 2016/0024147 A1 | 1/2016 | Tustian et al. |
| 2016/0264685 A1 | 9/2016 | Fouque et al. |

(Continued)

FOREIGN PATENT DOCUMENTS

| | | |
|---|---|---|
| EP | 2522724 A1 | 11/2012 |
| EP | 3674319 A1 | 7/2020 |

(Continued)

OTHER PUBLICATIONS

MacCallum et al., Mol. Biol 262: 732-745 (Year: 1996).*
Wu et al., J. Mol. Biol. 294: 151-162 (Year: 1999).*
Lloyd et al., Protein Engineering, Design & Selection 22:159-168 (Year: 2009).*
Edwards et al., J Mol Biol. 334(1): 103-118 (Year: 2003).*
Litvak-Greenfeld et al., Methods in molecular biology (Clifton, N.J.) vol. 1904, pp. 431-454, abstract only (Year: 2019).*
Zhu et al., Protein Science 6: 781-788 (Year: 1997).*
Brinkmann, Ulrich (Apr. 30, 2010) "Disulfide-Stabilized Fv Fragments", Antibody Engineering, Chapter 14, XP002622964, pp. 181-189.
Brinkmann, et al. (Jan. 10, 2017) "The Making of Bispecific Antibodies", mAbs, vol. 9, No. 2, XP055531122, pp. 182-212.
Extended European Search Report received for European Application No. 18306840.2, dated Sep. 20, 2019, 12 Pages.

(Continued)

*Primary Examiner* — Phuong Huynh

(74) *Attorney, Agent, or Firm* — LATHROP GPM LLP; James H. Velema, Esq.; Michael Spellberg

(57) ABSTRACT

Binding proteins comprising a pseudoFab domain including a stabilised knockout domain and a second VH/VL that form a first functional antigen binding domain are provided. Multispecific binding proteins comprising at least one pseudoFab are also provided. Multispecific binding proteins, nucleic acids encoding binding proteins and multispecific binding proteins, expression vectors, host cells, pharmaceutical composition and methods of treatment administering the binding proteins or multispecific binding proteins described herein are also provided.

36 Claims, 15 Drawing Sheets

Specification includes a Sequence Listing.

(56) References Cited

U.S. PATENT DOCUMENTS

| | | | |
|---|---|---|---|
| 2017/0145078 A1 | 5/2017 | Davis et al. | |
| 2017/0210818 A1 | 7/2017 | Wang et al. | |
| 2017/0291955 A1* | 10/2017 | Li | C07K 16/30 |
| 2020/0255540 A1 | 8/2020 | Beil et al. | |

FOREIGN PATENT DOCUMENTS

| | | |
|---|---|---|
| EP | 3902825 A1 | 11/2021 |
| WO | WO 2001077342 A1 | 10/2001 |
| WO | WO 2002002781 A1 | 1/2002 |
| WO | WO 2007/024715 A2 | 3/2007 |
| WO | WO 2009089004 A1 | 7/2009 |
| WO | WO 2010/075548 A2 | 7/2010 |
| WO | WO 2010129304 A2 | 11/2010 |
| WO | WO 2011078332 A1 | 6/2011 |
| WO | WO 2011117653 A1 | 9/2011 |
| WO | WO 2011131746 A2 | 10/2011 |
| WO | WO 2011143545 A1 | 11/2011 |
| WO | WO 2012/023053 A2 | 2/2012 |
| WO | WO 2012058768 A1 | 5/2012 |
| WO | WO 2012135345 A1 | 10/2012 |
| WO | WO 2013/088259 A2 | 6/2013 |
| WO | WO 2013/136186 A2 | 9/2013 |
| WO | WO 2014004586 A1 | 1/2014 |
| WO | WO 2014/049003 A1 | 4/2014 |
| WO | WO 2014106015 A2 | 7/2014 |
| WO | WO 2015033223 A2 | 3/2015 |
| WO | WO 2015188135 A1 | 12/2015 |
| WO | WO 2016018740 A2 | 2/2016 |
| WO | WO 2016026943 A1 | 2/2016 |
| WO | WO 2017005649 A1 | 1/2017 |
| WO | WO 2017180913 A2 | 10/2017 |
| WO | WO 2020/136564 A1 | 7/2020 |

OTHER PUBLICATIONS

MacCallum, et al. (Oct. 11, 1996) "Antibody-Antigen Interactions: Contact Analysis and Binding Site Topography", Journal of molecular biology, vol. 262, No. 5, pp. 732-745.

Martin, Andrew C.R. (2010) "Protein Sequence and Structure Analysis of Antibody Variable Domains", Chapter 3 of Antibody Engineering, vol. 2, Kontermann and Dubel Eds., Springer-Verlag, pp. 33-51.

Masui, et al. (Jan. 1, 2005) "An Efficient System to Establish Multiple Embryonic Stem Cell Lines Carrying an Inducible Expression Unit", Nucleic acids research, vol. 33, No. 4, e43, 8 Pages.

Niwa, et al. (Dec. 15, 1991) "Efficient Selection for High-Expression Transfectants with a Novel Eukaryotic Vector", Gene, vol. 108, No. 2, pp. 193-199.

Padlan, et al. (Jan. 1995) "Identification of Specificity-Determining Residues in Antibodies", The FASEB Journal, vol. 9, No. 1, pp. 133-139.

Reiter, et al. (Oct. 1996) "Engineering Antibody Fv Fragments for Cancer Detection and Therapy: Disulfide-Stabilized Fv Fragments", Nature Biotechnology, vol. 14, No. 10, pp. 1239-1245.

Schmiedl, et al. (Oct. 1, 2000) "Expression of a bispecific dsFv-dsFV antibody fragment in *Escherichia coli*", Protein Engineering, Oxford University Press, vol. 13, No. 10, XP002622933, pp. 725-734.

Suresh, et al. (Oct. 1, 1986) "Advantages of Bispecific Hybridomas in One-Step Immunocytochemistry and Immunoassays", Proceedings of the National Academy of Sciences, vol. 83, No. 20, pp. 7989-7993.

Extended European Search Report received for European Application No. 18306840.2, dated Sep. 20, 2019.

International Search Report & Written Opinion Received for PCT Application No. PCT/IB2019/061304, dated Jun. 3, 2020.

Kalim, et al., "Intracellular Trafficking of New Anticancer Therapeutics: Antibody-Drug Conjugates", Drug Design, Development and Therapy, vol. 11, pp. 2265-2276, Jan. 2017.

Karlin, et al., "Applications and Statistics For Multiple High-Scoring Segments In Molecular Sequences", Proceedings of the National Academy of Sciences of the USA, vol. 90, pp. 5873-5877, Jun. 1, 1993.

Lefranc, et al., "IMGT Unique Numbering for Immunoglobulin and T Cell Receptor Variable Domains and Ig Superfamily V-like Domains", Developmental & Comparative Immunology, vol. 27, No. 1, pp. 55-77, Jan. 2003.

Liu, et al., "Disulfide Bond Structures of IgG Molecules: Structural Variations, Chemical Modifications and Possible Impacts to Stability and Biological Function", In MAbs, vol. 4, No. 1, pp. 17-23, Jan. 2012.

Parslow, et al., "Antibody-Drug Conjugates for Cancer Therapy", Biomedicines, vol. 4, No. 14, 17 Pages, Sep. 2016.

Thompson, et al., "CLUSTAL W: Improving the Sensitivity of Progressive Multiple Sequence Alignment Through Sequence Weighting, Position-Specific Gap Penalties and Weight Matrix Choice", Nucleic Acids Research, vol. 22, No. 22, pp. 4673-4680, 1994.

* cited by examiner

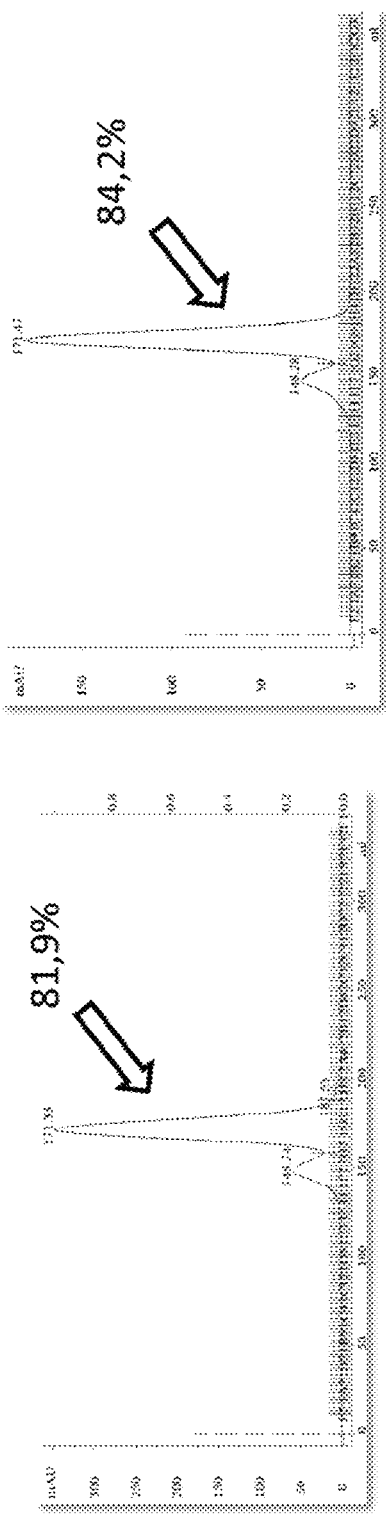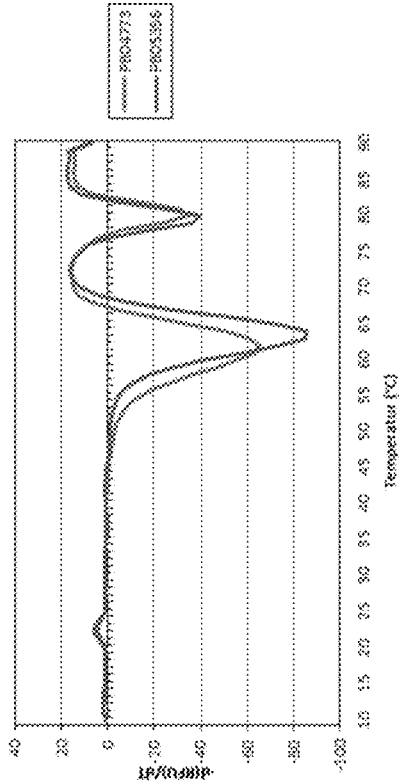
Fig. 3A  Fig. 3B  Fig. 3C

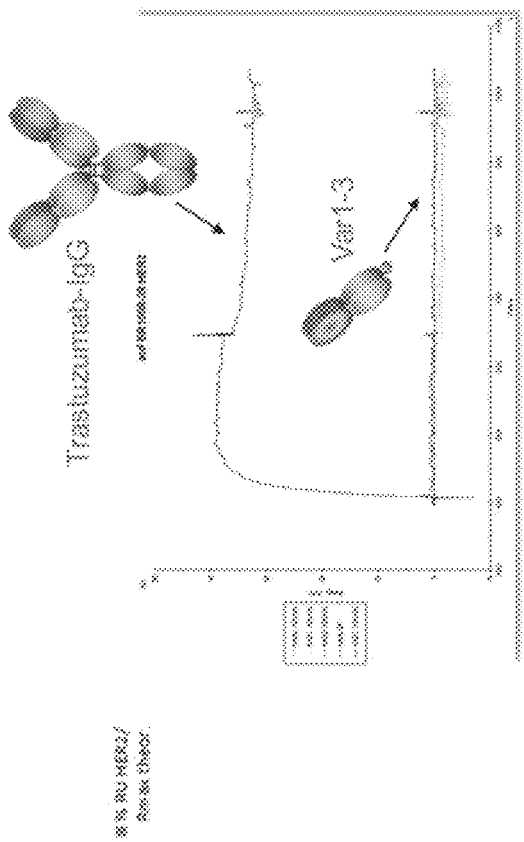
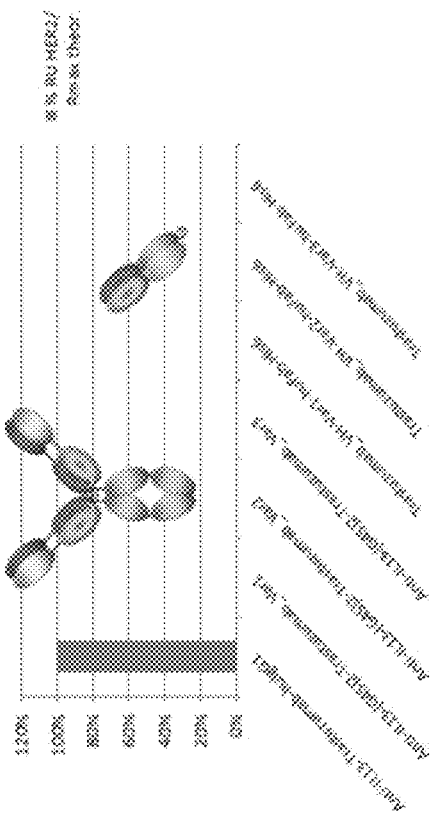
Fig. 5A
Fig. 5B

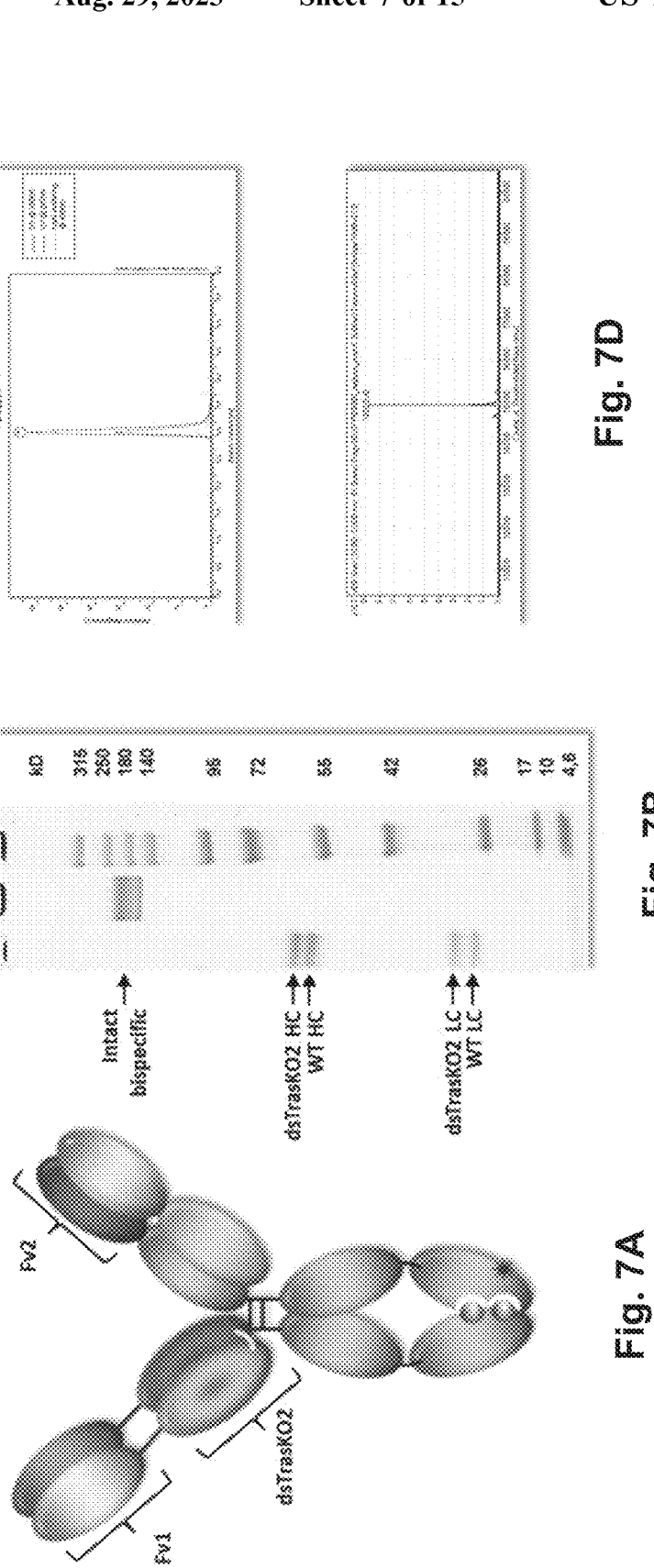

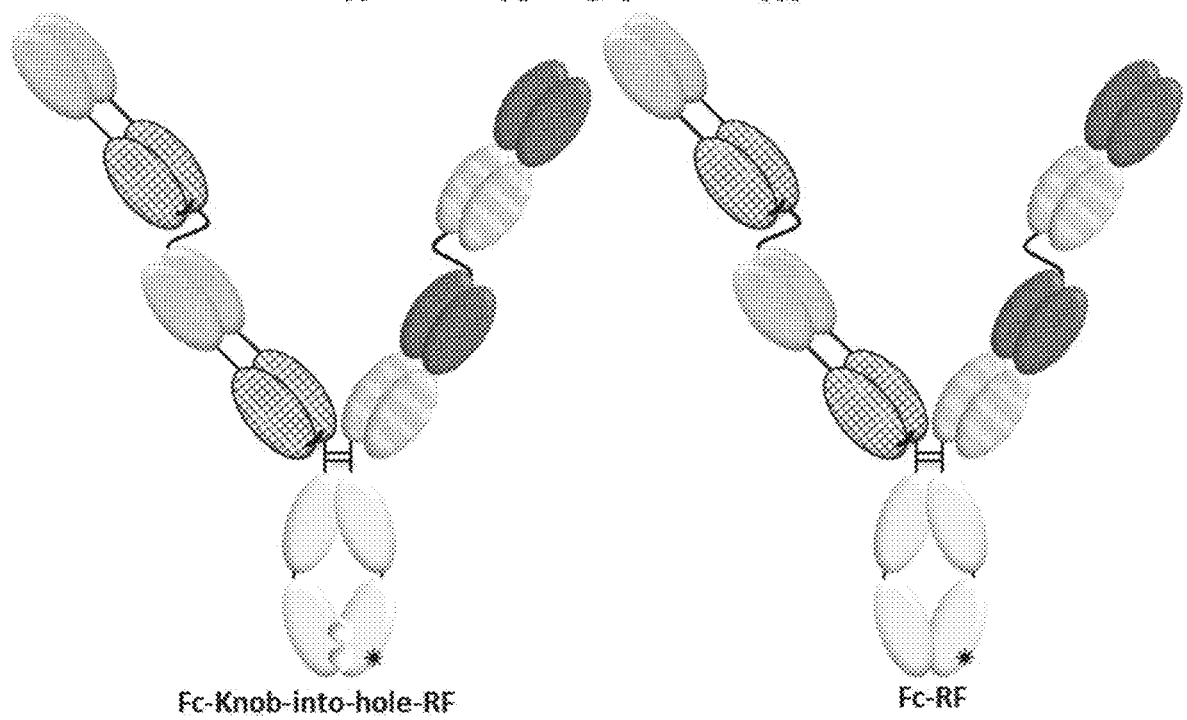
Fig. 11A   Fig. 11B
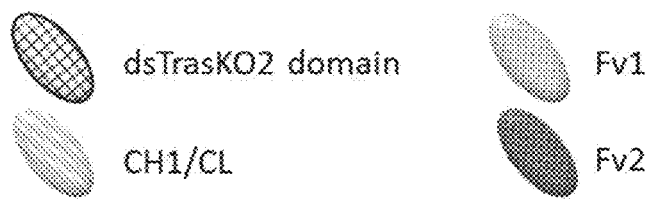

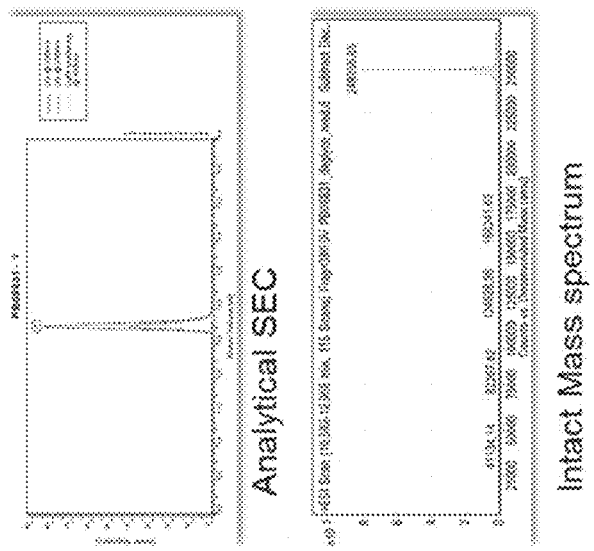
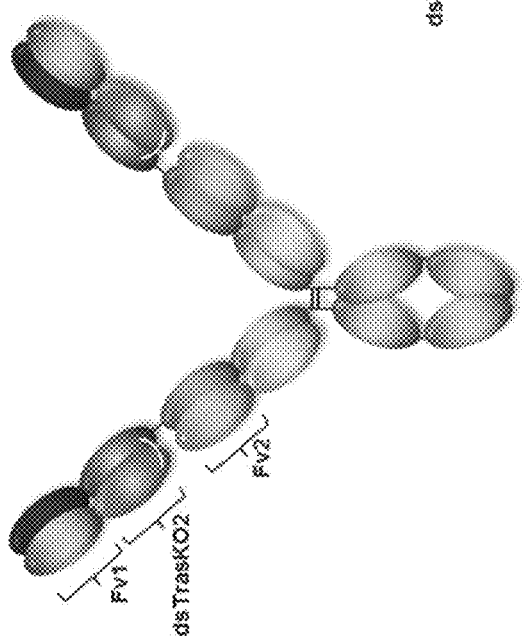
Fig. 12A Bispecific tandem IgG design
Fig. 12B SDS-PAGE
Fig. 12C Analytical SEC
Fig. 12D Intact Mass spectrum Analytical SEC Intact Mass spectrum

SDS-PAGE

Trispecific CODV IgG design

PSEUDOFAB-BASED MULTISPECIFIC BINDING PROTEINS

RELATED APPLICATIONS

The instant application claims priority to EP Application No. 18306840.2, filed Dec. 24, 2018, and EP Application No. 19305813.8, filed Jun. 21, 2019, the contents of which are incorporated herein by reference for all purposes.

BACKGROUND

The creation of asymmetry in a native antibody structure is a prerequisite for the generation of multispecific binding proteins having two (e.g., bispecific antibodies) or more binding specificities. For example, by separating one or more Fvs on different asymmetric binding arms or Fabs, a bispecific antibody can be made with the flexibility of binding two different antigens or epitopes simultaneously. Despite these advantages, however, a wide variety of multispecific antibody technologies suffer process and manufacturing problems due to mispairings of various asymmetric heavy and light chains. For example, many of these technologies suffer from the so-called "light-chain problem," wherein random pairing of the two different light chains with heavy chains generates various combinations of chain pairings other than the desired combination. In some cases, the light-chain problem can be circumvented by the use of a common light chain, which enables binding to both antigens or epitopes. However, this might not be possible for many antibodies since this format requires de novo antibody generation in transgenic mice. Furthermore, rare antibodies like broadly neutralizing anti-HIV antibodies derived from human patients cannot be adapted to such a format. Accordingly, there remains a need for alternative and creative solutions to the mispairing problem.

SUMMARY OF THE INVENTION

The present disclosure is based upon the discovery of a novel heterodimerization domain termed a "stabilized knockout domain" which may be used to form a "pseudoFab". As disclosed herein, a pseudoFab can be incorporated into a wide variety of binding proteins and binding formats to confer multispecific binding properties. In certain aspects, the pseudoFab moiety can facilitate preferential production, synthesis or purification of a desired multispecific binding protein while minimizing or eliminating the undesired chain mispairings that are commonly generated with conventional multispecific binding protein formats. In one aspect, the present disclosure provides a binding protein comprising:
a first pseudoFab portion comprising (1) a first VL domain (VLa) paired with a first VH domain (VHa) to form a first functional antigen binding site that binds target antigen A; (2) a first stabilized knockout VH domain (VHX) paired with a first stabilized knockout VL domain (VLX) to form a first stabilized knockout domain;
wherein the stabilized knockout domain comprises (3) one or more inactivating mutations which abolish binding to a target antigen; and (4) one or more engineered interchain disulfide bonds.

In one aspect, the present disclosure provides a binding protein comprising:
a first pseudoFab portion comprising (1) a first VL domain (VLa) paired with a first VH domain (VHa) to form a first functional antigen binding site that binds target antigen A; (2) a first stabilized knockout VH domain (VHX) paired with a first stabilized knockout VL domain (VLX) to form a first stabilized knockout domain;
wherein the stabilized knockout domain comprises (3) one or more inactivating mutations which abolish its binding to a target antigen relative to wild type domains and (4) one or more engineered interchain disulfide bonds which confer enhanced thermal stability (Tm) of the pseudoFab relative to a reference Fab molecule, wherein the reference Fab molecule is identical to the pseudoFab molecule except that, in a pseudoFab molecule, CH1 and CL domains of the reference Fab molecule are replaced with VHX and VLX domains.

In some embodiments, the binding protein is a multispecific binding protein further comprising:
at least a second VL domain (VLb) paired with a second VH domain (VHb) to form a second functional antigen binding site that binds target antigen B.

In one aspect, the present disclosure provides a multispecific binding protein comprising
a) a first pseudoFab portion comprising (1) a first VL domain (VLa) paired with a first VH domain (VHa) to form a first functional antigen binding site that binds target antigen A; (2) a first stabilized knockout VH domain (VHX) paired with a first stabilized knockout VL domain (VLX) to form a first stabilized knockout domain;
b) a first Fab portion comprising (3) a second VL domain (VLb) paired with second VH domain (VHb) to form a second functional antigen binding site that binds target antigen B; (4) a first CH1 domain paired with a first CL domain; and
wherein the stabilized knockout domain comprises (5) one or more inactivating mutations which abolish its binding to a target antigen; and (6) one or more engineered interchain disulfide bonds; or alternatively wherein the stabilized knockout domain comprises (5) one or more inactivating mutations which abolish its binding to a target antigen relative to wild type domains and (6) one or more engineered interchain disulfide bonds which confer enhanced thermal stability (Tm) of the pseudoFab relative to a reference Fab molecule, wherein the reference Fab molecule is identical to the pseudoFab molecule except that, in a pseudoFab molecule, CH1 and CL domains of the reference Fab molecule are replaced with VHX and VLX domains.

In another aspect, the present disclosure provides a multispecific binding protein comprising
a) a first pseudoFab portion comprising (1) a first VL domain (VLa) paired with a first VH domain (VHa) to form a first functional antigen binding site that binds target antigen A; (2) a first stabilized knockout VH domain (VHX) paired with a first stabilized knockout VL domain (VLX) to form a stabilized knockout domain, with the proviso that the first pseudoFab portion does not comprise a CH1 domain paired with a CL domain;
wherein the stabilized knockout domain comprises (3) one or more inactivating mutations which abolish its binding to a target antigen; and (4) one or more engineered interchain disulfide bonds; or alternatively wherein the stabilized knockout domain comprises (3) one or more inactivating mutations which abolish its binding to a target antigen relative to wild type domains and (4) one or more engineered interchain disulfide bonds which confer enhanced thermal stability (Tm) of the pseudoFab relative to a reference Fab molecule, wherein the reference Fab molecule is identical to the pseudoFab molecule except that, in a pseudoFab molecule, CH1 and CL domains of the reference Fab molecule are replaced with VHX and VLX domains;

b) a first Fab portion comprising (5) a second VL domain (VLb) paired with second VH domain (VHb) to form a second functional antigen binding site that binds target antigen B; (6) a first CH1 domain paired with a first CL domain; and c) a linker portion which operably links the first Fab portion and the first pseudoFab portion.

In another aspect, the present disclosure provides a multispecific binding protein comprising a) a first pseudoFab portion comprising (1) a first VL domain (VLa) paired with a first VH domain (VHa) to form a first functional antigen binding site that binds target antigen A; (2) a first stabilized knockout VH domain (VHX) paired with a first stabilized knockout VL domain (VLX) to form a first stabilized knockout domain;

b) a first Fab portion comprising (3) a second VL domain (VLb) paired with second VH domain (VHb) to form a second functional antigen binding site that binds target antigen B; (4) a first CH1 domain paired with a first CL domain; and wherein the stabilized knockout domain comprises (5) one or more inactivating mutations which abolish its binding to a target antigen; and (6) one or more engineered interchain disulfide bonds; or alternatively wherein the stabilized knockout domain comprises (5) one or more inactivating mutations which abolish its binding to a target antigen relative to wild type domains and (6) one or more engineered interchain disulfide bonds which confer enhanced thermal stability (Tm) of the pseudoFab relative to a reference Fab molecule, wherein the reference Fab molecule is identical to the pseudoFab molecule except that, in a pseudoFab molecule, CH1 and CL domains of the reference Fab molecule are replaced with VHX and VLX domains.

c) a linker portion which operably links the first Fab portion and the first pseudoFab portion.

In some embodiments, the linker portion is on one or more heavy chains.

In some embodiments, the multispecific binding protein further comprises a third VL domain (VLc) paired with a third VH domain (VHc), to form a third functional antigen binding site that binds target antigen C.

In some embodiments, the multispecific binding protein comprises independently one or two pseudoFab portion(s) and one or two Fab portion(s).

In some embodiments, the linker portion is a peptide linker. In some embodiments, the peptide linker is a Gly-Ser linker of the formulation $(Gly_4Ser)_n$, wherein n is 1-10.

In some embodiments, the heterodimerization domain comprises a full-length IgG antibody. In some embodiments, the heterodimerization domain comprises the Fc domain of a full-length IgG antibody or a functional fragment thereof.

In some embodiments, the binding protein comprises comprising separate proteins chains and selected from one of the following group:

(a) VHa-CH1-L1-VHb-L2-VHX and VLa-CL and VLb-L3-VLX;
(b) VHa-L2-VHX-L1-VHb-CH1 and VLa-L3-VLX and VLb-CL;
(c) VHa-CH1-L1-VHa-CH1 and VHb-L2-VHX-L3-VHb-L4-VHX and two chains VLb-L5-VLX and two chains VLa-CL;

wherein the chains of (a) and (b) can be present once or twice, and wherein L1, L2, L3, L4 and L5 are linkers, which may independently be the same or different.

The present disclosure provides a multispecific antibody comprising a) a first pseudoFab portion comprising:

(1) a first VL domain (VLa) paired with a first VH domain (VHa) to form a first antigen binding site that binds target antigen A;

(2) a first stabilized knockout VL domain (VLX) paired with a first stabilized knockout VH domain (VHX) to form a first disulfide stabilized knockout (dsKO) domain;

(3) a first heterodimerization domain (HD1);

wherein the first dsKO domain comprises (i) one or more inactivating mutations which abolish its binding to a target antigen and (ii) one or more engineered interchain disulfide bonds; or alternatively comprises (i) one or more inactivating mutations which abolish its binding to a target antigen relative to wild type domains and (ii) one or more engineered interchain disulfide bonds which confer enhanced thermal stability (Tm) of the pseudoFab relative to a reference Fab molecule, wherein the reference Fab molecule is identical to the pseudoFab molecule except that, in a pseudoFab molecule, CH1 and CL domains of the reference Fab molecule are replaced with VHX and VLX domains.

b) a first Fab portion comprising (1) a second VL domain (VLb) paired with second VH domain (VHb) to form a second functional antigen binding site that binds target antigen B;

(2) a first CH1 domain paired with a first CL domain; and (3) a second heterodimerization domain (HD2).

In some embodiments, the first heterodimerization domain (HD1) is operably linked to the C-terminus of the VHX domain of the pseudoFab portion.

In some embodiments, the second heterodimerization domain (HD2) is operably linked to the C-terminus of the first CH1 domain of the first Fab portion.

In some embodiments, the first and second heterodimerization domains comprise first and second Fc domains.

In some embodiments, the Fc domains comprise the general structure hinge-CH2 domain-CH3 domain.

In some embodiments, the Fc domains comprise one or more knob-in-hole (KIH) mutations.

In some embodiments, one of the Fc domains comprises a first CH3 domain comprising one or both of S354C and T366W mutations, and the other Fc domain comprises a second CH3 domain comprising one or both of Y349C, T366S, L368A, and Y407V mutations.

In some embodiments, the Fc domains comprise H435R and/or Y436F mutations.

In some embodiments, the first pseudoFab portion comprises of a first polypeptide chain having a structure represented by the formula:

N-VHa-L1-VHX-C          (Ia)

and a second polypeptide chain having a structure represented by the formula:

N-VLa-L2-VLX-C          (IIa)

wherein L1 and L2 are linkers, which may independently be present or absent, and wherein N and C represent the N- and C-terminal ends, respectively.

In some embodiments, the first pseudoFab portion comprises of a first polypeptide chain having a structure represented by the formula:

N-VHX-L1-VHa-C          (Ib)

and a second polypeptide chain having a structure represented by the formula:

N-VLX-L2-VLa-C (IIb)

wherein L1 and L2 are linkers, which may independently be present or absent, and wherein N and C represent the N- and C-terminal ends, respectively.

In some embodiments, the first pseudoFab portion comprises of a first polypeptide chain having a structure represented by the formula:

N-VLa-L1-VHX-C (Ic)

and a second polypeptide chain having a structure represented by the formula:

N-VHa-L2-VLX-C (IIc)

wherein L1 and L2 are linkers, which may independently be present or absent, and wherein N and C represent the N- and C-terminal ends, respectively.

In some embodiments, the first pseudoFab portion comprises of a first polypeptide chain having a structure represented by the formula:

N-VHX-L1-VLa-C (Id)

and a second polypeptide chain having a structure represented by the formula:

N-VLX-L2-VHa-C (IId)

wherein L1 and L2 are linkers, which may independently be present or absent, and wherein N and C represent the N- and C-terminal ends, respectively.

In some embodiments, at least two of Target Antigen A, Target Antigen B and Target Antigen C are different target antigens.

In some embodiments, at least one of the target antigens is a ligand of a cell surface receptor and at least one of the target antigens is a cell surface receptor.

In some embodiments, the antigen binding sites are derived from different antibodies.

In some embodiments, Target Antigen A, Target Antigen B, and Target Antigen C are the same target antigen.

In some embodiments, the antigen binding sites bind different epitopes on the same target antigen.

In some embodiments, the antigen binding sites bind the same epitope on the same target antigen.

In some embodiments, the antigen binding sites are derived from the same antibody.

In some embodiments, the melting temperature ($T_m$) of the pseudoFab portion at least 4 degrees Celsius higher than the reference Fab molecule.

In some embodiments, the engineered interchain disulfide bond is VH44C-VL100C.

In some embodiments, the engineered interchain disulfide bond is VH105C-VL43C.

In some embodiments, at least one of the one or more inactivating mutations which abolish binding to the target antigen are present in the VHX domain of the pseudoFab portion.

In some embodiments, at least one of the one or more inactivating mutations which abolish binding to the target antigen are present in the CDRH3 of the VHX domain.

In some embodiments, at least one of the one or more inactivating mutations which abolish binding to the target antigen are present in the CDRH2 of the VHX domain.

In some embodiments, at least one of the one or more inactivating mutations which abolish binding to the target antigen are present in the CDRH1 of the VHX domain.

In some embodiments, at least one of the one or more inactivating mutations which abolish binding to the target antigen are present in the VLX domain of the PseudoFab portion.

In some embodiments, at least one of the one or more inactivating mutations which abolish binding to the target antigen are present in the CDRL3 of the VLX domain.

In some embodiments, at least one of the one or more inactivating mutations which abolish binding to the target antigen are present in the CDRL2 of the VLX domain.

In some embodiments, at least one of the one or more inactivating mutations which abolish binding to the target antigen are present in the CDRL1 of the VLX domain.

In some embodiments, the VHX domain of the pseudoFab portion comprises comprises an amino acid sequence selected from the group consisting of SEQ ID NO: 77, SEQ ID NO: 78 and SEQ ID NO: 79.

In some embodiments, the VLX/VHX pair is selected from the group consisting of:
  (i) VLX comprising an amino acid sequence of SEQ ID NO: 76 and VHX comprising an amino acid sequence of SEQ ID NO: 77;
  ii) VLX comprising an amino acid sequence of SEQ ID NO: 76 and VHX comprising an amino acid sequence of SEQ ID NO: 78; and
  iii) VLX comprising an amino acid sequence of SEQ ID NO: 76 and VHX comprising an amino acid sequence of SEQ ID NO: 79.

In some embodiments, the binding protein further comprises one or more additional binding domains operably linked to an N- or C-terminus of the binding protein.

In some embodiments, the one or more additional binding domains are operably linked to N-terminus of the first or second pseudoFab portion.

In some embodiments, the one or more additional binding domains are operably linked to N-terminus of the first or second Fab portion.

In another aspect, the present disclosure provides a multispecific binding protein comprising four polypeptide chains that form at least two antigen-binding sites, wherein (a) a first polypeptide comprises a structure represented by the formula:

VLa-L1-VLX [I]

(b) a second polypeptide comprises a structure represented by the formula:

VHa-L2-VHX-FC1 [II]

(c) a third polypeptide comprises a structure represented by the formula:

VLb-CL [III]

(d) a fourth polypeptide comprises a structure represented by the formula:

VHb-CH1-FC2 [IV]

wherein:
VLa is a first immunoglobulin light chain variable domain;
VLb is a second immunoglobulin light chain variable domain;
VHa is a first immunoglobulin heavy chain variable domain;
VHb is a second immunoglobulin heavy chain variable domain;

VLX is a stabilized knockout light chain variable domain;
VHX is a stabilized knockout heavy chain variable domain;
CL is an immunoglobulin light chain constant domain;
CH1 is an immunoglobulin CH1 heavy chain constant domain;
FC1 and FC2 are Fc domains comprising an immunoglobulin hinge region and CH2 and CH3 immunoglobulin heavy chain constant domains; and
L1 and L2 are amino acid linkers, which may independently be the same or different; wherein
  (1) the first VL domain (VLa) is paired with a first VH domain (VHa) to form a first functional antigen binding site that binds target antigen A;
  (2) the second VL domain (VLb) is paired with a second VH domain (VHb) to form a second functional antigen binding site that binds target antigen B;
  (3) the stabilized knockout VL domain (VLX) is paired with the stabilized knockout VH domain (VHX) to form a disulfide stabilized knockout (dsKO) domain;
wherein the dsKO domain comprises (i) one or more inactivating mutations which abolish its binding to a target antigen; and (ii) one or more engineered interchain disulfide bonds.

In another aspect, the present disclosure provides an antigen binding protein comprising six polypeptide chains that form four antigen-binding sites, wherein
  (a) the first and second polypeptides comprise a structure represented by the formula:

VLa-L1-VLX                    [I] and [II]

(b) the third and fourth polypeptides comprise a structure represented by the formula:

VLb-CL                        [III] and [IV]

(c) the fifth polypeptide comprises a structure represented by the formula:

VHa-L2-VHX-L3-VHb-CH1-FC1     [V]

(d) the sixth polypeptide comprises a structure represented by the formula:

VHa-L2-VHX-L3-VHb-CH1-FC2     [VI]

wherein:
VLa is a first immunoglobulin light chain variable domain;
VLb is a second immunoglobulin light chain variable domain;
VHa is a first immunoglobulin heavy chain variable domain;
VHb is a second immunoglobulin heavy chain variable domain;
VLX is a stabilized knockout light chain variable domain;
VHX is a stabilized knockout heavy chain variable domain;
CL is an immunoglobulin light chain constant domain;
CH1 is an immunoglobulin heavy chain constant domain;
FC1 and FC2 are Fc domains comprising an immunoglobulin hinge region and CH2 and CH3 immunoglobulin heavy chain constant domains; and
L1, L2 and L3 are amino acid linkers,
wherein
  (1) the first VL domain (VLa) is paired with the first VH domain (VHa) to form a first functional antigen binding site that binds target antigen A;
  (2) the second VL domain (VLb) is paired with the second VH domain (VHb) to form a second functional antigen binding site that binds target antigen B;
  (3) the stabilized knockout VL domain (VLX) is paired with the stabilized knockout VH domain (VHX) to form a disulfide stabilized knockout (dsKO) domain;
wherein the dsKO domains comprise (i) one or more inactivating mutations which abolish its binding to a target antigen; and (ii) one or more engineered interchain disulfide bonds.

In another aspect, the present disclosure provides an antigen binding protein comprising six polypeptide chains that form four antigen-binding sites, wherein
  (a) the first and second polypeptides comprise a structure represented by the formula:

VLa-L1-VLX                    [I] and [II]

(b) the third and fourth polypeptides comprise a structure represented by the formula:

VLb-CL                        [III] and [IV]

(c) the fifth polypeptide comprises a structure represented by the formula:

VHb-CH1-L3-VHa-L2-VHX-FC1     [V]

(d) the sixth polypeptide comprises a structure represented by the formula:

VHb-CH1-L3-VHa-L2-VHX-FC2     [VI]

wherein:
VLa is a first immunoglobulin light chain variable domain;
VLb is a second immunoglobulin light chain variable domain;
VHa is a first immunoglobulin heavy chain variable domain;
VHb is a second immunoglobulin heavy chain variable domain;
VLX is a stabilized knockout light chain variable domain;
VHX is a stabilized knockout heavy chain variable domain;
CL is an immunoglobulin light chain constant domain;
CH1 is an immunoglobulin heavy chain constant domain;
FC1 and FC2 are Fc domains comprising an immunoglobulin hinge region and CH2 and CH3 immunoglobulin heavy chain constant domains; and
L1, L2 and L3 are amino acid linkers,
wherein
  (1) the first VL domain (VLa) is paired with the first VH domain (VHa) to form a first functional antigen binding site that binds target antigen A;
  (2) the second VL domain (VLb) is paired with the second VH domain (VHb) to form a second functional antigen binding site that binds target antigen B;
  (3) the stabilized knockout VL domain (VLX) is paired with the stabilized knockout VH domain (VHX) to form a disulfide stabilized knockout (dsKO) domain;
wherein the dsKO domains comprise (i) one or more inactivating mutations which abolish its binding to a target antigen; (ii) one or more engineered interchain disulfide bonds.

In another aspect, the present disclosure provides an antigen binding protein comprising six polypeptide chains that form four antigen-binding sites, wherein
  (a) the first and second polypeptides comprise a structure represented by the formula:

VLa-L1-VLX                    [I] and [II]

(b) the third and fourth polypeptides comprise a structure represented by the formula:

VLb-CL                        [III] and [IV]

(c) the fifth polypeptide comprises a structure represented by the formula:

VHa-L2-VHX-L3-VHa-L4-VHX-FC1  [V]

(d) the sixth polypeptide comprises a structure represented by the formula:

VHb-CH1-L5-VHb-CH1-FC2  [VI]

wherein:
VLa is a first immunoglobulin light chain variable domain;
VLb is a second immunoglobulin light chain variable domain;
VHa is a first immunoglobulin heavy chain variable domain;
VHb is a second immunoglobulin heavy chain variable domain;
VLX is a stabilized knockout light chain variable domain;
VHX is a stabilized knockout heavy chain variable domain;
CL is an immunoglobulin light chain constant domain;
CH1 is an immunoglobulin heavy chain constant domain;
FC1 and FC2 are Fc domains comprising an immunoglobulin hinge region and CH2 and CH3 immunoglobulin heavy chain constant domains; and
L1, L2, L3, L4 and L5 are amino acid linkers, wherein
(1) the first VL domain (VLa) is paired with the first VH domain (VHa) to form a first functional antigen binding site that binds target antigen A;
(2) the second VL domain (VLb) is paired with the second VH domain (VHb) to form a second functional antigen binding site that binds target antigen B;
(3) the stabilized knockout VL domain (VLX) is paired with the stabilized knockout VH domain (VHX) to form a disulfide stabilized knockout (dsKO) domain;
wherein the dsKO domains comprise (i) one or more inactivating mutations which abolish its binding to a target antigen; and (ii) one or more engineered interchain disulfide bonds.

In another aspect, the present disclosure provides an antigen-binding protein comprising four polypeptide chains that form three antigen-binding sites, wherein:
(a) the polypeptide comprises a structure represented by the formula:

VLa-L1-VLX  [I]

(b) the second polypeptide comprises a structure represented by the formula:

VHa-L2-VHX-FC1  [II]

(c) the third polypeptide comprises a structure represented by the formula:

VLb-L3-VLc-L4-CL  [III]

(d) the fourth polypeptide comprises a structure represented by the formula:

VHc-L5-VHb-L6-CH1-FC2  [IV]

wherein:
VLa is a first immunoglobulin light chain variable domain;
VLb is a second immunoglobulin light chain variable domain;
VLc is a third immunoglobulin light chain variable domain;
VHa is a first immunoglobulin heavy chain variable domain;
VHb is a second immunoglobulin heavy chain variable domain;
VHc is a third immunoglobulin heavy chain variable domain;
CL is an immunoglobulin light chain constant domain;
CH1 is an immunoglobulin CH1 heavy chain constant domain;
VLX is a first stabilized knockout light chain variable domain;
VHX is a first stabilized knockout heavy chain variable domain;
FC1 and FC2 are Fc domains comprising an immunoglobulin hinge region and CH2 and CH3 immunoglobulin heavy chain constant domains; and
L1, L2, L3, L4, L5 and L6 are amino acid linkers, wherein
(1) the first VL domain (VLa) is paired with the first VH domain (VHa) to form a first functional antigen binding site that binds target antigen A;
(2) the second VL domain (VLb) is paired with the second VH domain (VHb) to form a second functional antigen binding site that binds target antigen B;
(3) the third VL domain (VLc) is paired with the third VH domain (VHc) to form a first functional antigen binding site that binds target antigen C;
(4) the polypeptide of formula III and the polypeptide of formula IV form a cross-over light chain-heavy chain pair (CODV);
(5) the stabilised knockout VL domain (VLX) is paired with the stabilized knockout VH domain (VHX) to form a disulfide stabilized knockout (dsKO) domain;
wherein the dsKO domain comprises (i) one or more inactivating mutations which abolish its binding to a target antigen; and (ii) one or more engineered interchain disulfide bonds.

In another aspect, the present disclosure provides an antigen-binding protein comprising four polypeptide chains that form three antigen-binding sites, wherein:
(a) the polypeptide comprises a structure represented by the formula:

VLa-L1-VLX  [I]

(b) the second polypeptide comprises a structure represented by the formula:

VHa-L2-VHX-FC1  [II]

(c) the third polypeptide comprises a structure represented by the formula:

VLb-L3-VLc-L4-CL  [III]

(d) the fourth polypeptide comprises a structure represented by the formula:

VHc-L5-VHb-L6-CH1-FC2  [IV]

wherein:
VLa is a first immunoglobulin light chain variable domain;
VLb is a second immunoglobulin light chain variable domain;
VLc is a third immunoglobulin light chain variable domain;
VHa is a first immunoglobulin heavy chain variable domain;
VHb is a second immunoglobulin heavy chain variable domain;
VHc is a third immunoglobulin heavy chain variable domain;
CL is an immunoglobulin light chain constant domain;
CH1 is an immunoglobulin CH1 heavy chain constant domain;
VLX is a first stabilized knockout light chain variable domain;
VHX is a first stabilized knockout heavy chain variable domain;
FC1 and FC2 are Fc domains comprising an immunoglobulin hinge region and CH2 and CH3 immunoglobulin heavy chain constant domains; and
L1, L2, L3, L4, L5 and L6 are amino acid linkers, wherein
(1) the first VL domain (VLa) is paired with the first VH domain (VHa) to form a first functional antigen binding site that binds target antigen A;

(2) the second VL domain (VLb) is paired with the second VH domain (VHb) to form a second functional antigen binding site that binds target antigen B;

(3) the third VL domain (VLc) is paired with the third VH domain (VHc) to form a first functional antigen binding site that binds target antigen C;

(4) the polypeptide of formula III and the polypeptide of formula IV form a cross-over light chain-heavy chain pair (CODV);

(5) the stabilised knockout VL domain (VLX) is paired with the stabilized knockout VH domain (VHX) to form a disulfide stabilized knockout (dsKO) domain;

wherein the dsKO domain comprises (i) one or more inactivating mutations which abolish its binding to a target antigen of a reference Fab molecule; and (ii) one or more engineered interchain disulfide bonds.

In other aspects, some embodiments are related to all the binding proteins described herein wherein the dsKO domain comprises (i) one or more inactivating mutations which abolish its binding to a target antigen relative to wild type domains and (ii) one or more engineered interchain disulfide bonds which confer enhanced thermal stability (Tm) of the pseudoFab relative to a reference Fab molecule, wherein the reference Fab molecule is identical to the pseudoFab molecule except that, in a pseudoFab molecule, CH1 and CL domains of the reference Fab molecule are replaced with VHX and VLX domains. In those embodiments, binding to a target antigen is measured by methods known in the art such as but not limited to surface plasmon resonance and thermal stability is measured by methods known in the art such as but not limited to Differential Scanning calorimetry.

In some embodiments, the FC1 and FC2 domains comprise one or more knob-in-hole (KIH) mutations, wherein the mutations facilitate Fc domain heterodimerization the polypeptides.

In some embodiments, one of FC1 or FC2 comprises a first CH3 domain comprising one or both of S354C and T366W mutations, and the other of FC1 or FC2 comprises a second CH3 domain comprising one or both of Y349C, T366S, L368A, and Y407V mutations, wherein the mutations facilitate Fc domain heterodimerization.

In some embodiments, the FC1 or FC2 domains comprise H435R and/or Y436F mutations.

In some embodiments, at least two of Target Antigen A, Target Antigen B and Target Antigen C are different target antigens.

In some embodiments, at least one of the target antigens is a ligand of a cell surface receptor and at least one of the target antigens is a cell surface receptor.

In some embodiments, the antigen binding sites are derived from different antibodies.

In some embodiments, Target Antigen A, Target Antigen B, and Target Antigen C are the same target antigen.

In some embodiments, the antigen binding sites bind different epitopes on the same target antigen.

In some embodiments, the antigen binding sites bind the same epitope on the same target antigen.

In some embodiments, the antigen binding sites are derived from the same antibody.

In some embodiments, the melting temperature ($T_m$) of the pseudoFab portion at least 4 degrees Celsius higher than the reference Fab molecule.

In some embodiments, the engineered interchain disulfide bond is VH44C-VL100C.

In some embodiments, the engineered interchain disulfide bond is VH105C-VL43C.

In some embodiments, at least one of the one or more inactivating mutations which abolish binding to the target antigen are present in the VHX domain of the pseudoFab portion.

In some embodiments, at least one of the one or more inactivating mutations which abolish binding to the target antigen are present in the CDRH3 of the VHX domain.

In some embodiments, at least one of the one or more inactivating mutations which abolish binding to the target antigen are present in the CDRH2 of the VHX domain.

In some embodiments, at least one of the one or more inactivating mutations which abolish binding to the target antigen are present in the CDRH1 of the VHX domain.

In some embodiments, at least one of the one or more inactivating mutations which abolish binding to the target antigen are present in the VLX domain of the pseudoFab portion.

T In some embodiments, at least one of the one or more inactivating mutations which abolish binding to the target antigen are present in the CDRL3 of the VLX domain.

In some embodiments, at least one of the one or more inactivating mutations which abolish binding to the target antigen are present in the CDRL2 of the VLX domain.

In some embodiments, at least one of the one or more inactivating mutations which abolish binding to the target antigen are present in the CDRL1 of the VLX domain.

In some embodiments, the VHX domain of the pseudoFab portion comprises an amino acid sequence selected from the group consisting of SEQ ID NO: 77, SEQ ID NO: 78 and SEQ ID NO: 79.

In some embodiments, the VLX/VHX pair is selected from the group consisting of:
  (i) VLX comprising an amino acid sequence of SEQ ID NO: 76 and VHX comprising an amino acid sequence of SEQ ID NO: 77;
  ii) VLX comprising an amino acid sequence of SEQ ID NO: 76 and VHX comprising an amino acid sequence of SEQ ID NO: 78; and
  iii) VLX comprising an amino acid sequence of SEQ ID NO: 76 and VHX comprising an amino acid sequence of SEQ ID NO: 79.

In another aspect, the present disclosure provides for the use of a stabilized knockout domain to reduce heavy chain-light chain mispairing in a multispecific binding protein wherein the stabilized knockout domain comprises VHX and VLX domains comprising (3) one or more inactivating mutations which abolish its binding to the target antigen; and (4) one or more engineered interchain disulfide bonds which confer enhanced thermal stability (Tm) of the pseudoFab relative to a reference Fab molecule, wherein the reference Fab molecule is identical to the pseudoFab molecule except that, in a pseudoFab molecule, CH1 and CL domains of the reference Fab molecule are replaced with VHX and VLX domains.

In some embodiments, the engineered interchain disulfide bond is VH44C-VL100C.

In some embodiments, the engineered interchain disulfide bond is VH105C-VL43C.

In some embodiments, the VHX domain of the pseudoFab portion comprises an amino acid sequence selected from the group consisting of SEQ ID NO: 77, SEQ ID NO: 78 and SEQ ID NO: 79.

In some embodiments, the VLX/VHX pair is selected from the group consisting of:
  (i) VLX comprising an amino acid sequence of SEQ ID NO: 76 and VHX comprising an amino acid sequence of SEQ ID NO: 77;

ii) VLX comprising an amino acid sequence of SEQ ID NO: 76 and VHX comprising an amino acid sequence of SEQ ID NO: 78; and iii) VLX comprising an amino acid sequence of SEQ ID NO: 76 and VHX comprising an amino acid sequence of SEQ ID NO: 79.

In some embodiments, the pseudoFab lacks the CH1 and CL domains.

In some embodiments, an isolated nucleic acid molecule comprising a nucleotide sequence encoding one or more of the binding protein is provided. In some embodiments, a kit of isolated nucleic acid molecules comprising one or more nucleotide sequences encoding one or more of the binding proteins is provided.

In some embodiments, an expression vector comprising the nucleic acid molecule is provided. In some embodiments, a kit of expression vectors comprising the kit of nucleic acid molecules is provided.

In some embodiments, an isolated host cell comprising the nucleic acid molecule or the expression vector is provided. In some embodiments, an isolated host cell comprising the kit of nucleic acid molecules or the kit of expression vectors is provided.

In some embodiments, a method of producing the binding protein comprising culturing the host cell under conditions such that the binding protein is expressed; and purifying the binding protein from the host cell, is provided.

In some embodiments, a pharmaceutical composition comprising a pharmaceutically acceptable carrier and a therapeutically effective amount of the multispecific binding protein, is provided. In some embodiments, a multispecific binding protein for use as a medicament is provided.

In some embodiments, a method of treating a disorder in which antigen activity is detrimental, the method comprising administering to a subject in need thereof an effective amount of a multispecific binding protein is provided.

The summary of the invention described above is non-limiting and other features and advantages of the disclosed composition and methods will be apparent from the following detailed description of the invention, and from the claims.

BRIEF DESCRIPTION OF THE SEQUENCES

SEQ ID NO: 1: Variable light chain sequence of trastuzumab.
SEQ ID NO: 2: Variable heavy chain sequence of trastuzumab.
SEQ ID NO: 3: Variable heavy chain sequence of trastuzumab ko variant 1.
SEQ ID NO: 4: Variable heavy chain sequence of trastuzumab ko variant 2.
SEQ ID NO: 5: Variable heavy chain sequence of trastuzumab ko variant 3.
SEQ ID NO: 6: anti-IL13-VL-G4S-anti-Her2-(Trastuzumab-Q1000)-VL.
SEQ ID NO: 7: anti-IL13-VH-G4S-anti-Her2-(Trastuzumab-G440)-VH-Fc-huIgG1.
SEQ ID NO: 8: anti-IL13-VL-(G4S)2-anti-Her2-(Trastuzumab-Q1000)-VL.
SEQ ID NO: 9: anti-IL13-VH-(G4S)2-anti-Her2-(Trastuzumab-G440)-VH-Fc-huIgG1.
SEQ ID NO: 10: anti-IL13-VL3-IGK.
SEQ ID NO: 11: anti-IL13-VH2-IGHG1.
SEQ ID NO: 12: anti-TNFalpha-VL-G4S-anti-Her2-(Trastuzumab-Q1000)-VL.
SEQ ID NO: 13: anti-TNFalpha-VH-G4S-anti-Her2-(Trastuzumab-G440)-VH-Fc-huIgG1.
SEQ ID NO: 14: anti-TNFalpha-VL-(G4S)2-anti-Her2-(Trastuzumab-Q1000)-VL.
SEQ ID NO: 15: anti-TNFalpha-VH-(G4S)2-anti-Her2-(Trastuzumab-G440)-VH-Fc-huIgG1.
SEQ ID NO: 16: anti-TNFa-VL-huIGKC.
SEQ ID NO: 17: anti-TNFa-VH-huIgG1.
SEQ ID NO: 18: anti-IL6R-VL-G4S-anti-Her2-(Trastuzumab-Q1000)-VL.
SEQ ID NO: 19: anti-IL6R-VH-G4S-anti-Her2-(Trastuzumab-G440)-VH-Fc-huIgG1.
SEQ ID NO: 20: anti-IL6R-VL-(G4S)2-anti-Her2-(Trastuzumab-Q100C)-VL
SEQ ID NO: 21: anti-IL6R-VH-(G4S)2-anti-Her2-(Trastuzumab-G440)-VH-Fc-huIgG1.
SEQ ID NO: 22: anti-IL6R-VL-huIGKC.
SEQ ID NO: 23: anti-IL6R-VH-huIgG1.
SEQ ID NO: 24: anti-CTLA4-VL-G4S-anti-Her2-(Trastuzumab-Q1000)-VL.
SEQ ID NO: 25: anti-CTLA4-VH-G4S-anti-Her2-(Trastuzumab-G440)-VH-Fc-huIgG1.
SEQ ID NO: 26: anti-CTLA4-VL-(G4S)2-anti-Her2-(Trastuzumab-Q100C)-VL.
SEQ ID NO: 27: anti-CTLA4-VH-(G4S)2-anti-Her2-(Trastuzumab-G440)-VH-Fc-huIgG1.
SEQ ID NO: 28: anti-CTLA4-VL-huIGKC.
SEQ ID NO: 29: anti-CTLA4-VH-huIgG1.
SEQ ID NO: 30: anti-PD1-VL-G4S-anti-Her2-(Trastuzumab-Q100C)-VL.
SEQ ID NO: 31: anti-PD1-VH-G4S-anti-Her2-(Trastuzumab-G440)-VH-Fc-huIgG1.
SEQ ID NO: 32: anti-PD1-VL-(G4S)2-anti-Her2-(Trastuzumab-Q1000)-VL
SEQ ID NO: 33: anti-PD1-VH-(G4S)2-anti-Her2-(Trastuzumab-G440)-VH-Fc-huIgG1.
SEQ ID NO: 34: anti-huPD-1-VL-huIGKC.
SEQ ID NO: 35: anti-huPD-1-VH-huIgG1.
SEQ ID NO: 36: anti-IL4-VL-G4S-anti-Her2-(Trastuzumab-Q1000)-VL.
SEQ ID NO: 37: anti-IL4-VH-G4S-anti-Her2-(Trastuzumab-G440)-VH-Fc-huIgG1.
SEQ ID NO: 38: anti-IL4-VL-(G4S)2-anti-Her2-(Trastuzumab-Q1000)-VL.
SEQ ID NO: 39: anti-IL4-VH-(G4S)2-anti-Her2-(Trastuzumab-G440)-VH-Fc-huIgG1.
SEQ ID NO: 40: anti-IL4-VL1-IGKC.
SEQ ID NO: 41: anti-IL4-VH1-IgG1.
SEQ ID NO: 42: anti-PD1-VL-(G4S)2-anti-Her2-(Trastuzumab-Q1000)-VL.
SEQ ID NO: 43: anti-PD1-VH-(G4S)2-anti-Her2-(Trastuzumab-G44C-Var2)-VH-Fc-huIgG1.
SEQ ID NO: 44: anti-CTLA4-VL-(G4S)2-anti-Her2-(Trastuzumab-Q100C)-VL.
SEQ ID NO: 45: anti-CTLA4-VH-(G4S)2-anti-Her2-(Trastuzumab-G44C-Var2)-VH-Fc-huIgG1.
SEQ ID NO: 46: anti-IL4-VL-(G4S)2-anti-Her2-(Trastuzumab-Q100C)-VL.
SEQ ID NO: 47: anti-IL4-VH-(G4S)2-anti-Her2-(Trastuzumab-G44C-Var2)-VH-Fc-huIgG1.
SEQ ID NO: 48: anti-IL13-VL-(G4S)2-anti-Her2-(Trastuzumab-Q1000)-VL.
SEQ ID NO: 49: anti-IL13-VH-(G4S)2-anti-Her2-(Trastuzumab-G44C-Var2)-VH-DKTHT-His6.
SEQ ID NO: 50: anti-IL13-VL-(G4S)2-anti-Her2-(Trastuzumab-Q100C)-VL.

SEQ ID NO: 51: anti-IL13-VH-(G4S)2-anti-Her2-(Trastuzumab-VH_Var1-G440)-VH-Fc-huIgG1.
SEQ ID NO: 52: anti-IL4-VL-(G4S)2-anti-Her2-(Trastuzumab-Q100C)-VL.
SEQ ID NO: 53: anti-IL4-VH-(G4S)2-anti-Her2-(Trastuzumab-G44C-Var2)-VH-Fc-huIgG1(knob).
SEQ ID NO: 54: anti-PD1-huIGKC.
SEQ ID NO: 55: anti-PD1-VH-huIgG1(hole-RF).
SEQ ID NO: 56: anti-IL13-VL-(G4S)2-anti-Her2-(Trastuzumab-Q100C)-VL.
SEQ ID NO: 57: anti-IL13-VH-(G4S)2-anti-Her2-(Trastuzumab-G44C-Var2)-VH-Fc-huIgG1(knob).
SEQ ID NO: 58: anti-PD1-VL-huIGKC.
SEQ ID NO: 59: anti-PD1-VH-huIgG1(hole-RF).
SEQ ID NO: 60: anti-PD1-VL-(G4S)2-anti-Her2-(Trastuzumab-Q100C)-VL.
SEQ ID NO: 61: anti-PD1-VH-(G4S)2-anti-Her2-(Trastuzumab-G44C-Var2)-VH-Fc-huIgG1(knob).
SEQ ID NO: 62: anti-IL13-VL huIGKC.
SEQ ID NO: 63: anti-IL13-VH-huIgG1(hole-RF).
SEQ ID NO: 64: anti-CTLA4-VL-(G4S)2-anti-Her2-(Trastuzumab-Q100C)-VL.
SEQ ID NO: 65: anti-CTLA4-VH-(G4S)2-anti-Her2-(Trastuzumab-G44C-Var2)-VH-Fc-huIgG1(knob).
SEQ ID NO: 66: anti-PD1-VL-huIGKC.
SEQ ID NO: 67: anti-PD1-VH-huIgG1(hole-RF).
SEQ ID NO: 68: anti-IL4-VL-(G4S)2-anti-Her2-(Trastuzumab-Q100C)-VL.
SEQ ID NO: 69: anti-IL4-VH-(G4S)2-anti-Her2-(Trastuzumab-G44C-Var2)-VH-Fc-huIgG1(knob).
SEQ ID NO: 70: anti-IL13-VL huIGKC.
SEQ ID NO: 71: anti-IL13-VH-huIgG1(hole-RF).
SEQ ID NO: 72: anti-PD1-VL-(G4S)2-anti-Her2-(Trastuzumab-Q1000)-VL.
SEQ ID NO: 73: anti-PD1-VH-(G4S)2-anti-Her2-(Trastuzumab-G44C-Var2)-VH-Fc-huIgG1(knob).
SEQ ID NO: 74: anti-PD1-VL-huIGKC.
SEQ ID NO: 75: anti-PD1-VH-huIgG1(hole-RF).
SEQ ID NO: 76: Variable light chain sequence of ds ko trastuzumab.
SEQ ID NO: 77: Variable heavy chain sequence of ds ko trastuzumab variant 1.
SEQ ID NO: 78: Variable heavy chain sequence of ds ko trastuzumab variant 2.
SEQ ID NO: 79: Variable heavy chain sequence of ds ko trastuzumab variant 3.
SEQ ID NO: 80: anti-TCR α/β×anti-CD123 Wild Type
SEQ ID NO: 81: anti-TCR α/β×anti-CD123—dsTrasKO2
SEQ ID NO: 82: anti-TCR α/β—dsTrasKO2×anti-CD123
SEQ ID NO: 83: anti-CD3ε×anti-CD123 Wild Type
SEQ ID NO: 84: anti-CD3ε×anti-CD123-dsTrasKO2
SEQ ID NO: 85: anti-CD3ε-dsTrasKO2×anti-CD123
SEQ ID NO: 86: anti-CD3ε×anti-CD123 Wild Type
SEQ ID NO: 87: anti-CD3ε×anti-CD123-dsTrasKO2
SEQ ID NO: 88: anti-CD3ε-dsTrasKO2×anti-CD123
SEQ ID NO: 89: anti-TCR α/β×anti-TNP Negative control—Wild Type
SEQ ID NO: 90: anti-TCR α/β×anti-TNP-dsTrasKO2 Negative control
SEQ ID NO: 91: anti-TCR α/β-dsTrasKO2×anti-TNP Negative control
SEQ ID NO: 92: anti-TNP×anti-CD123 Negative control—Wild Type
SEQ ID NO: 93: anti-TNP×anti-CD123-dsTrasKO2 Negative control
SEQ ID NO: 94: anti-TNP-dsTrasKO2×anti-CD123 Negative control
SEQ ID NO: 95: anti-CD3ε×anti-TNP Negative control—Wild Type
SEQ ID NO: 96: anti-CD3ε×anti-TNP-dsTrasKO2 Negative control
SEQ ID NO: 97: anti-CD3ε-dsTrasKO2×anti-TNP Negative control
SEQ ID NO: 98: anti-CD3ε×anti-TNP Negative control—Wild Type
SEQ ID NO: 99: anti-CD3ε×anti-TNP-dsTrasKO2 Negative control
SEQ ID NO: 100: anti-CD3ε-dsTrasKO2×anti-TNP Negative control

BRIEF DESCRIPTION OF THE DRAWINGS

The foregoing and other features and advantages of the present invention will be more fully understood from the following detailed description of illustrative embodiments taken in conjunction with the accompanying drawings. The patent or application file contains at least one drawing executed in color. Copies of this patent or patent application publication with color drawing(s) will be provided by the Office upon request and payment of the necessary fee.

FIG. 3A-FIG. 3C schematically depict the monomeric fraction of an antibody construct comprising Trastuzumab WT VH/VL replacement of CH1/CL (FIG. 3A) compared to an antibody construct comprising disulfide stabilized Trastuzumab knuck ("dsTrastKO") VH/VL replacement of CH1/CL (FIG. 3B), as well as the thermostability of both constructs (FIG. 3C).

FIG. 5A-FIG. 5B graphically depict the results of binding experiments demonstrating that dsTrastuKO variants 1-3 no longer bind HER2.

FIG. 7A-FIG. 7D depict a representative bispecific format and purification results according to certain exemplary embodiments. FIG. 7A shows the arrangement of the individual domains within the IgG scaffold. Fv1 (anti-IL4) is fused to VL/VH of dsTrasKO2 via (G4S)2 linker. Fv2 (anti-IL13) retains the wildtype configuration. FIG. 7B shows the reduced (one light and one heavy chain) and oxidized form of the antibody using 4-12% Bis/Tris MOPS sodium dodecyl sulfate polyacrylamide gel electrophoresis (SDS-PAGE). The purity of the product is shown in FIG. 7C using analytical size exclusion chromatography. Molecule integrity was verified by intact mass analysis using Agilent 6540 ultra-high definition (UHD) Q-TOF equipped with a Jet Stream dual ESI interface and an Agilent 1290/1260 Infinity LC System (FIG. 7D).

FIG. 11A-11B schematically depict dimeric bispecific tandem molecules comprising pseudoFab fragments with replacement of a CH1/CL pair with a disulfide stabilized Knockout domain (dsKO). (((Fv-pseudoFab)[HC]-(Fv-pseudoFab))×((Fv-Fab)[HC]-(Fv-Fab)))-Fc molecule is depicted in FIG. 11A with an Fc heterodimerization domain with knob-into-hole (KIH) and RF mutations, and in FIG. 11B. with RF mutations only.

FIG. 12A-FIG. 12D depict a representative bispecific tandem IgG design in which a first pseudoFab comprising a Fv1 domain (having binding specificity for a first Target Antigen A, i.e., GITR) and a dsTrasKO domain is appended to each Fv2 domain (having binding specificity for a second Target antigen B, i.e., Ox40) of a conventional IgG antibody (Pogalizumab). FIG. 12A shows the arrangement of the individual domains within the IgG scaffold. Fv1 (anti-GITR) is fused to VL/VH of dsTrasKO2 via (G4S)2 linker. Fv2 (anti-Ox40) retains the wildtype configuration. Fv1-dsTrasKO2 is fused to Fv2-Ck/CH1 via (G4S)2 linker. FIG. 12B shows the reduced (two light and one heavy chain) and oxidized form of the antibody using 4-12% Bis/Tris MOPS sodium dodecyl sulfate polyacrylamide gel electrophoresis (SDS-PAGE). The purity of the product is shown in FIG. 12C using analytical size exclusion chromatography. Molecule integrity was verified by intact mass analysis using Agilent 6540 ultra-high definition (UHD) Q-TOF equipped with a Jet Stream dual ESI interface and an Agilent 1290/1260 Infinity LC System (FIG. 12D).

FIG. 13A shows the arrangement of the individual domains within the CODV IgG scaffold. Fv1 (anti-Ox40) and Fv2 (anti-PD1) on the CODV arm are fused to wildtype lambda and CH1 domains. Fv3 (anti-CD137) on the Fab arm is fused to VL/VH of dsTrasKO2 via (G4S)2 linker. FIG. 13B shows the reduced (two light and two heavy chains) and oxidized form of the CODV antibody using 4-12% Bis/Tris MOPS sodium dodecyl sulfate polyacrylamide gel electrophoresis (SDS-PAGE). The purity of the product is shown in FIG. 13C using analytical size exclusion chromatography. Molecule integrity was verified by intact mass analysis using Agilent 6540 ultra-high definition (UHD) Q-TOF equipped with a Jet Stream dual ESI interface and an Agilent 1290/1260 Infinity LC System (FIG. 13D).

FIG. 15A corresponds to bispecific antibodies with ID numbers 33, 34, and 35 with negative controls 45 and 46. FIG. 15B corresponds to bispecific antibodies with ID numbers 36, 37, and 38 with negative controls 47 and 48. T effector cells and CFSE-labeled THP-1 target cells were seeded in an effector to target ratio of 10:1 and co-incubated with serial dilutions of respective bispecific molecules (10 nM-0 nM) for 20 hours at 37° C. Dead cells were stained with 7-AAD and measured by flow cytometry. Cytotoxic activity was calculated based on percentage of dead THP-1 target cells (7-AAD/CFSE double positive). Data show dead target cells [%] against concentration of bispecific molecules [pM] as mean of two representative healthy donors.

DETAILED DESCRIPTION

I. Definitions

Figure 1:
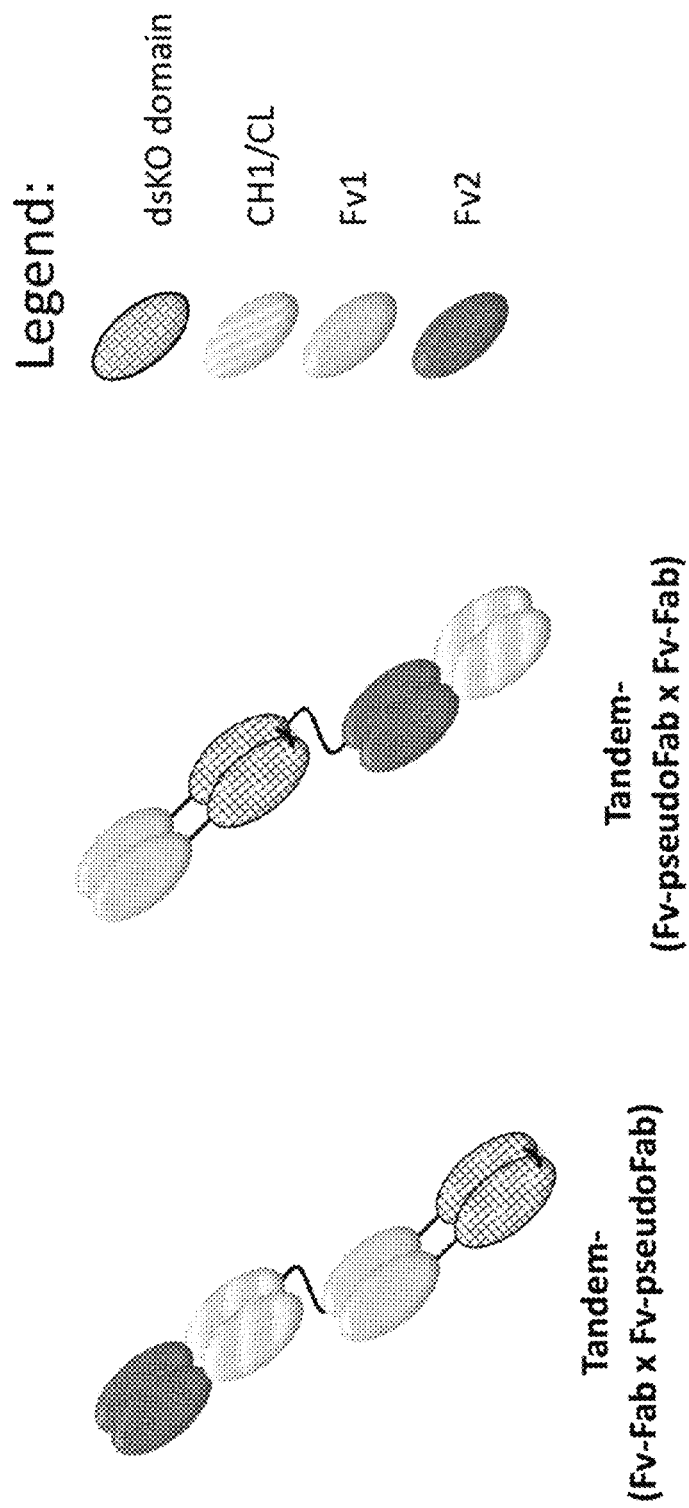
FIG. 1A-FIG. 1B schematically depict dimeric bispecific tandem molecules comprising pseudoFab fragments with replacement of a CH1/CL pair with a disulfide stabilized Knockout domain (dsKO). A Tandem-(Fv-Fab×Fv-pseudoFab) molecule is depicted in FIG. 1A, and a Tandem-(Fv-pseudoFab×Fv-Fab) molecule is depicted in FIG. 1B.

That the disclosure may be more readily understood, selected terms are defined below.

As used herein, the twenty conventional amino acids and their abbreviations follow conventional usage. Stereoisomers (e.g., D-amino acids) of the twenty conventional amino acids; unnatural amino acids such as a-disubstituted amino acids, N-alkyl amino acids, lactic acid, and other unconventional amino acids may also be suitable components for the polypeptide chains of the binding proteins of the invention. Examples of unconventional amino acids include: 4-hydroxyproline, y-carboxyglutamate, c-N,N,N-trimethyllysine, c-N-acetyllysine, 0-phosphoserine, N-acetylserine, N-formylmethionine, 3-methylhistidine, 5-hydroxylysine, u-N-methylarginine, and other similar amino acids and imino acids (e.g., 4-hydroxyproline). In the polypeptide notation used herein, the left-hand direction is the amino terminal direction and the right-hand direction is the carboxyl-terminal direction, in accordance with standard usage and convention. Naturally occurring residues may be divided into classes based on common side chain properties (see Table 1).

TABLE 1

| Charge properties/<br>Hydrophobicity | Side group | Amino Acid |
| --- | --- | --- |
| nonpolar hydrophobic | aliphatic | Ala, Ile, Leu, Val |
|  | aliphatic,<br>S-containing | Met |
|  | aromatic | Phe, Trp |
|  | imino | Pro |
| polar uncharged | aliphatic | Gly |
|  | amide | Asn, Gln |
|  | aromatic | Tyr |
|  | hydroxyl | Ser, Thr |
|  | sulfhydryl | Cys |
| positively charged | basic | Arg, His, Lys |
| negatively charged | acidic | Asp, Glu |

Conservative amino acid substitutions may involve exchange of a member of one of these classes with another member of the same class. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid residues. Non-conservative substitutions may involve the exchange of a member of one of these classes for a member from another class.

As used herein, the term "mutation" or "mutated" refers to an alteration of the amino acid sequence by deletion, insertion and/or substitution of one or more amino acids. A mutation is introduced with respect to a given sequence, e.g., the amino acid sequence of a VL1 and/or VH1 pair that specifically recognizes epitope 1. The term "non-mutated" refers to any amino acid sequence exhibiting functional properties, e.g., any sequence still showing binding properties. This is illustrated as follows: A VH1/VL1 is mutated in such that it does not specifically bind to an epitope. The non-mutated form of this VH1/VL1 still specifically binds to epitope 1. Every VH/VL domain of an antibody binding to any epitope is thus, suitable to be mutated to serve as a scaffold protein of the invention.

As used herein, the term "variant" refers to an amino acid sequence that is at least 80%, 85%, 90%, 95%, 96%, 97%, 98% or 99% identical to the amino acid sequence it is derived from, for example SEQ ID NO: 1 or SEQ ID NO: 2. The determination of percent identity between two sequences is accomplished using the mathematical algorithm of Karlin and Altschul, Proc. Natl. Acad. Sci. USA 90, 5873-5877, 1993. Such an algorithm is incorporated into the BLASTN and BLASTP programs of Altschul et al. (1990) J. Mol. Biol. 215, 403-410. To obtain gapped alignments for comparative purposes, Gapped BLAST is utilized as described in Altschul et al. (1997) Nucleic Acids Res. 25, 3389-3402. When utilizing BLAST and Gapped BLAST programs, the default parameters of the respective programs are used. Alternatively, a variant can also be defined as having up to 20, 15, 10, 5, 4, 3, 2, or 1 amino acid substitutions, in particular conservative amino acid substitutions. Conservative substitutions are well known in the art (see for example Creighton (1984) Proteins. W.H. Freeman and Company). An overview of physical and chemical properties of amino acids is given in Table 1 above. In a particular embodiment, conservative substitutions are substitutions made with amino acids having at least one property according to Table 1 in common (i.e., of column 1 and/or 2). The term "variant" also includes fragments. A fragment has an N-terminal and/or C-terminal deletion of up to 20, 15, 10, 5, 4, 3, 2, or 1 amino acid(s) in total. In addition or alternatively, the variant may be modified, for example by N-terminal and/or C-terminal amino acid additions of up to 50, 40, 30, 20, 10, 5, 4, 3, 2, or 1 amino acid(s) in total.

As used herein, the term "binding protein" or "binding polypeptide" refers to a polypeptide (e.g., an antibody or fragment thereof) that contains at least one binding site which is responsible for selectively binding to a target antigen of interest (e.g., a human antigen). Exemplary binding sites include, but are not limited to, an antibody variable domain, a ligand binding site of a receptor, or a receptor binding site of a ligand. In certain aspects, the binding polypeptides comprise multiple (e.g., two, three, four, or more) binding sites. In certain aspects, the binding protein is not a therapeutic enzyme.

As used herein, the term "Her2" or "HER2" refers to human epidermal growth factor receptor 2 which is a member of the epidermal growth factor receptor family.

As used herein, the term "binding protein" refers to a non-naturally occurring or recombinant or engineered molecule capable of specifically binding to at least one antigen. In a particular embodiment, a binding protein comprises at least one VH/VL pair that specifically binds to an antigen.

Production of a bispecific binding protein by co-expression of the two light and two heavy chains in a single host cell can be highly challenging because of the low yield of desired bispecific binding protein and the difficulty in removing closely related mispaired binding protein contaminants (Suresh et al., Proc. Natl. Acad. Sci. U.S.A. 83, 7989-7993, 1986). This is because heavy chains form homodimers as well as the desired heterodimers, referred to herein as the "heavy chain-pairing problem." Additionally, light chains can mispair with non-cognate heavy chains, referred to herein as the "light chain pairing problem." Consequently, co-expression of two antibodies can give rise to up to nine unwanted species in addition to the desired bispecific binding proteins.

As used herein a "heterodimerization domain" refers to a subunit of a bi- or a multispecific binding protein that facilitates, directs or forces the correct assembly of light chains and their cognate heavy chains to result in the desired protein while preventing mispairing of the respective light or heavy chains.

As used herein, the term "heterodimerizing Fc" or "functional fragment of a heterodimerizing Fc refers to a mutant form of the constant domain, e.g., the CH2-CH3 or CH2-CH3-CH4, that is mutated with regard to a naturally occurring Fc part in that it no longer forms homodimers but forms a heterodimer with a correspondingly mutated Fc part. Thus, the term refers to one part of the two chains that form a heterodimer. Several of such pairs are known in the art and comprise, e.g., knob-in-hole (KIH) variant or a EV-RWT variant.

Ridgeway and coworkers generated a CH3 interface favoring heterodimeric assembly by replacing small side chains on one CH3 interface with larger ones to create a knob and replacing large side chains on the other CH3 domain with smaller ones to generate a hole. Testing such variants demonstrated a preferential heterodimerization. This original knobs-into-holes mutations were further extended to identify further suitable combinations by phage display which were used to generate bispecific IgG antibodies testing additional substitutions allowing for disulfide bond formation. The knobs-in-hole variants are described further in U.S. Pat. Nos. 5,732,168 and 8,216,805, which are herein incorporated by reference. Accordingly, in an embodiment, the CH3 domain of one FC domain or heterodimerization domain contains the mutations Y349C, T366S, L368A, and Y407V, and the CH3 domain of another FC domain or heterodimerization domain contains the mutations S354C and T366W (amino acid position being indicated by reference to an IgG1 sequence).

As used herein, the term "homodimerization domain" refers to a domain mediating the homodimerization of two like domains, e.g., two heavy chains. Heavy chain pairing is mediated by the last domain of the constant region, i.e., CH3 in IgG molecules, which forms high-affinity homodimer complexes (KD~10 pM). Further interactions reside in the hinge region responsible for covalent linkage of two heavy chains, which form after heavy chain assembly. Interaction in a CH3 homodimer involves approximately 16 residues at the CH3-CH3 interface as shown for human γ1 CH3 with patch formed by 6 residues (T366, L368, F405, Y407 and K409) at the center of the interface strongly contributing to stability. Homodimerization domains include, but are not limited to, Fc regions and effector modified variants thereof and fragments of either, CH2 domains or fragments thereof, CH3 domains or fragments thereof, CH4 domains or fragments or the like.

Naturally-occurring antibodies typically comprise a tetramer. Each such tetramer is typically composed of two identical pairs of polypeptide chains, each pair having one full-length "light" chain (typically having a molecular weight of about 25 kDa) and one full-length "heavy" chain (typically having a molecular weight of about 50-70 kDa). The terms "heavy chain" and "light chain," as used herein, refer to any immunoglobulin polypeptide having sufficient variable domain sequence to confer specificity for a target antigen. The amino-terminal portion of each light and heavy chain typically includes a variable domain of about 100 to 110 or more amino acids that typically is responsible for antigen recognition. The carboxy-terminal portion of each chain typically defines a constant domain responsible for effector function. Thus, in a naturally occurring antibody, a full-length heavy chain IgG immunoglobulin polypeptide includes a variable domain (VH) and three constant domains (CHI, CH2, and CH3), wherein the VH domain is at the amino-terminus of the polypeptide and the CH3 domain is at the carboxyl-terminus, and a full-length light chain immunoglobulin polypeptide includes a variable domain (VL) and a constant domain (CL), wherein the VL domain is at the amino-terminus of the polypeptide and the CL domain is at the carboxyl-terminus.

Human light chains are typically classified as kappa and lambda light chains, and human heavy chains are typically classified as mu, delta, gamma, alpha, or epsilon, and define the antibody's isotype as IgM, IgD, IgG, IgA, and IgE, respectively. IgG has several subclasses, including, but not limited to, IgG1, IgG2, IgG3, and IgG4. IgM has subclasses including, but not limited to, IgM1 and IgM2. IgA is similarly subdivided into subclasses including, but not limited to, IgA1 and IgA2. Within full-length light and heavy chains, the variable and constant domains typically are joined by a "J" region of about 12 or more amino acids, with the heavy chain also including a "D" region of about 10 more amino acids. See, e.g., Fundamental Immunology (Paul, W., ed., Raven Press, 2nd ed., 1989), which is incorporated by reference in its entirety for all purposes. The variable regions of each light/heavy chain pair typically form an antigen binding site. The variable domains of naturally occurring antibodies typically exhibit the same general structure of relatively conserved framework regions (FR) joined by three hypervariable regions, also called complementarity determining regions or CDRs. The CDRs from the two chains of each pair typically are aligned by the framework regions, which may enable binding to a specific epitope. From the amino-terminus to the carboxyl-terminus, both light and heavy chain variable domains typically comprise the domains FR1, CDR1, FR2, CDR2, FR3, CDR3, and FR4.

As used herein, the term "CDR sets" refers to a group of three CDRs that occur in a single variable region capable of binding the antigen. The exact boundaries of these CDRs have been defined differently according to different systems. The system described by Kabat (Kabat et al., SEQUENCES OF PROTEINS OF IMMUNOLOGICAL INTEREST (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia and Lesk, 1987, *J. Affol. Biol.* 196: 901-17; Chothia et al., 1989, Nature 342: 877-83) found that certain sub-portions within Kabat CDRs adopt nearly identical peptide backbone conformations, despite having great diversity at the level of amino acid sequence. These sub-portions were designated as L1, L2, and L3 or H1, H2, and H3 where the "L" and the "H" designate the light chain and the heavy chain regions, respectively. These regions may be referred to as Chothia CDRs, which have boundaries that overlap with Kabat CDRs. Other boundaries defining CDRs overlapping with the Kabat CDRs have been described by Padlan, 1995, *FASEB J.* 9: 13339; MacCallum, 1996, *J. Mol. Biol.* 262(5): 732-45; and Lefranc, 2003, *Dev. Comp. Immunol.* 27: 55-77. Still other CDR boundary definitions may not strictly follow one of the herein systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although certain embodiments use Kabat or Chothia defined CDRs. Identification of predicted CDRs using the amino acid sequence is well known in the field, such as in Martin, A. C. "Protein sequence and structure analysis of antibody variable domains," *In Antibody Engineering*, Vol. 2. Kontermann R., Dikel S., eds. Springer-Verlag, Berlin, p. 33-51 (2010). The amino acid sequence of the heavy and/or light chain variable domain may be also inspected to identify the sequences of the CDRs by other conventional methods, e.g., by comparison to known amino acid sequences of other heavy and light chain variable regions to determine the regions of sequence hypervariability. The numbered sequences may be aligned by eye, or by employing an alignment program such as one of the CLUSTAL suite of programs, as described in Thompson, 1994, *Nucleic Acids Res.* 22: 4673-80. Molecular models are conventionally used to correctly delineate framework and CDR regions and thus correct the sequence-based assignments.

In some embodiments, CDR/FR definition in an immunoglobulin light or heavy chain is to be determined based on IMGT definition (Lefranc et al. Dev. Comp. Immunol., 2003, 27(1):55-77; www.imgt.org).

The term "Fc," as used herein, refers to a molecule comprising the sequence of a non-antigen-binding fragment resulting from digestion of an antibody or produced by other means, whether in monomeric or multimeric form, and can contain the hinge region. The original immunoglobulin source of the native Fc is typically of human origin and can be any of the immunoglobulins, although IgG1 and IgG2 are used in exemplary embodiments. Fc molecules are made up of monomeric polypeptides that can be linked into dimeric or multimeric forms by covalent (i.e., disulfide bonds) and non-covalent association. The number of intermolecular disulfide bonds between monomeric subunits of native Fc molecules ranges from 1 to 4 depending on class (e.g., IgG, IgA, and IgE) or subclass (e.g., IgG1, IgG2, IgG3, IgA1, and IgGA2). One example of a Fc is a disulfide-bonded dimer resulting from papain digestion of an IgG. The term "native Fc," as used herein, is generic to the monomeric, dimeric and multimeric forms.

An F(ab) fragment typically includes one light chain and the VH and CH1 domains of one heavy chain, wherein the VH-CH1 heavy chain portion of the F(ab) fragment cannot form a disulfide bond with another heavy chain polypeptide.

As used herein, an F(ab) fragment can also include one light chain containing two variable domains separated by an amino acid linker and one heavy chain containing two variable domains separated by an amino acid linker and a CH1 domain.

A F(ab') fragment typically includes one light chain and a portion of one heavy chain that contains more of the constant region (between the CH1 and CH2 domains), such that an interchain disulfide bond can be formed between two heavy chains to form a F(ab')$_2$ molecule.

As used herein, the term "$T_m$" refers to the melting temperature of a binding protein, an antigen-binding protein, an antibody and is a parameter critical for the thermal stability of antigen-binding proteins. The $T_m$ commonly refers to the thermal stability of the Fv fragment, i.e., a variable region heavy and light chain (VH/VL). The $T_m$ can be measured by differential scanning calorimetry (DSC).

One embodiment of the disclosure provides binding proteins having biological and immunological specificity to between one and three target antigens. Another embodiment of the disclosure provides nucleic acid molecules comprising nucleotide sequences encoding polypeptide chains that form such binding proteins. Another embodiment of the disclosure provides expression vectors comprising nucleic acid molecules comprising nucleotide sequences encoding polypeptide chains that form such binding proteins. Yet another embodiment of the disclosure provides host cells that express such binding proteins (i.e., comprising nucleic acid molecules or vectors encoding polypeptide chains that form such binding proteins).

The term "antigen" or "target antigen" or "antigen target," as used herein, refers to a molecule or a portion of a molecule (e.g., an epitope) that is capable of being bound by a binding protein, and additionally is capable of being used in an animal to produce antibodies capable of binding to an epitope of that antigen. A target antigen may have one or more epitopes. With respect to each target antigen recognized by a binding protein, the binding protein is capable of competing with an intact antibody that recognizes the target antigen.

As used herein, the term "epitope" or "target epitope" or "epitope target" refers to any determinant, e.g., a polypeptide determinant, capable of specifically binding to an immunoglobulin or T-cell receptor. For example, but in no way limiting, a target epitope A may be a first epitope of an antigen and a target epitope B may be a second epitope of the antigen. Alternatively, the target epitope B may be a second epitope on a second antigen. In certain embodiments, epitope determinants include chemically active surface groupings of molecules such as amino acids, sugar side chains, phosphoryl groups, or sulfonyl groups, and, in certain embodiments, may have specific three-dimensional structural characteristics and/or specific charge characteristics. An epitope is a region of an antigen that is bound by an antibody or by an antigen-binding fragment of an antibody or by a binding protein. In certain embodiments, a binding protein is said to specifically bind an antigen when it preferentially recognizes its target antigen in a complex mixture of proteins and/or macromolecules. In some embodiments, a binding protein is said to specifically bind an antigen when the equilibrium dissociation constant is <$10^{-8}$ M, when the equilibrium dissociation constant is <$1^{-9}$ M, or when the dissociation constant is <$10^{-10}$ M.

As used herein, the term "linker" refers to 0-100 contiguous amino acid residues. The linkers are, present or absent, and same or different. Linkers may all have the same amino acid sequence or may all have different amino acid sequences.

In some embodiments, the term "linker" refers to 1-15 contiguous amino acid residues. Typically, a linker provides flexibility and spatial separation between two amino acids or between two polypeptide domains. A linker may be inserted between VH, VL, CH and/or CL domains to provide sufficient flexibility and mobility for the domains of the light and heavy chains depending on the format of the molecule, e.g., to fold into cross over dual variable region immunoglobulins. A linker is typically inserted at the transition between variable domains between variable and knockout domain, or between variable and constant domains, respectively, at the amino sequence level. The transition between domains can be identified because the approximate size of the immunoglobulin domains are well understood. The precise location of a domain transition can be determined by locating peptide stretches that do not form secondary structural elements such as beta-sheets or alpha-helices as demonstrated by experimental data or as can be determined by techniques of modeling or secondary structure prediction. In certain exemplary embodiments, the linker may be inserted between Fab domains to create a tandem Fab antibody. In particular embodiments, the linker may be inserted between the N terminus of a VH domain of a first Fab and the C terminus of a CH1 domain of a second Fab.

The identity and sequence of amino acid residues in the linker may vary depending on the type of secondary structural element(s) necessary to achieve in the linker. For example, glycine, serine and alanine are suitable for linkers having maximum flexibility. Certain combinations of glycine, proline, threonine and serine are useful if a more rigid and extended linker is desired. Any amino acid residue may be considered as a linker in combination with other amino acid residues to construct larger peptide linkers as needed depending on the desired properties.

In some embodiments, a linker comprises: a single glycine (Gly) residue; a diglycine peptide (Gly-Gly); a tripeptide (Gly-Gly-Gly); a peptide with four glycine residues (Gly-Gly-Gly-Gly; SEQ ID NO: 3); a peptide with five glycine residues (Gly-Gly-Gly-Gly-Gly; SEQ ID NO: 4); a peptide with six glycine residues (Gly-Gly-Gly-Gly-Gly-Gly; SEQ ID NO: 5); a peptide with seven glycine residues (Gly-Gly-Gly-Gly-Gly-Gly-Gly; SEQ ID NO: 6); and a peptide with eight glycine residues (Gly-Gly-Gly-Gly-Gly-Gly-Gly-Gly; SEQ ID NO: 7).

In some embodiments, a linker comprises small amino acids, like Gly, Ala or Ser.

In some embodiments, a linker comprises Gly and Ser, or GS, GGS, GGGS or GGGGS. In some embodiments, a linker comprises (Gly-Gly-Gly-Gly-Ser)$_2$ (i.e., (GGGGS)$_2$) (SEQ ID NO: 1). In some embodiments, a linker comprises (Gly-Gly-Gly-Gly-Ser)$_3$ (i.e., (GGGGS)$_3$) (SEQ ID NO: 1).

In some embodiments, a linker comprises Gly-Gly-Gly-Gly-Ser (SEQ ID NO: 9), the peptide Gly-Gly-Gly-Gly-Ser-Gly-Gly-Gly-Gly-Ser (SEQ ID NO: 10), the peptide Gly-Gly-Gly-Gly-Ser-Gly-Gly-Gly-Gly-Ser-Gly-Gly-Gly-Gly-Ser (SEQ ID NO: 11), and the peptide Gly-Gly-Ser-Gly-Ser-Ser-Gly-Ser-Gly-Gly (SEQ ID NO: 12).

In some embodiments, a linker comprises a single Ser residue; a single Val residue; a dipeptide selected from Arg-Thr, Gln-Pro, Ser-Ser, Thr-Lys, and Ser-Leu; Thr-Lys-Gly-Pro-Ser (SEQ ID NO: 13), Thr-Val-Ala-Ala-Pro (SEQ ID NO: 14), Gln-Pro-Lys-Ala-Ala (SEQ ID NO: 15), Gln-Arg-Ile-Glu-Gly (SEQ ID NO: 16); Ala-Ser-Thr-Lys-Gly-Pro-Ser (SEQ ID NO: 17), Arg-Thr-Val-Ala-Ala-Pro-Ser (SEQ ID NO: 18), Gly-Gln-Pro-Lys-Ala-Ala-Pro (SEQ ID NO: 19), His-Ile-Asp-Ser-Pro-Asn-Lys (SEQ ID NO: 20), and Asp-Lys-Thr-His-Thr (SEQ ID NO: 21).

In some embodiments, two tandem Fabs are linked through a (Gly-Gly-Gly-Gly-Ser)$_2$ (SEQ ID NO: 1) linker. In some embodiments, the linker between a stabilized knocked out domain and a VH/VL pair is (Gly-Gly-Gly-Gly-Ser)$_2$ (SEQ ID NO: 1) linker.

In some embodiments having CODV-Fab portion wherein L1 and L2 are on the light chain and L3 and L4 are on the heavy chains, L1 is 3 to 12 amino acid residues in length, L2 is 3 to 14 amino acid residues in length, L3 is 1 to 8 amino acid residues in length, and L4 is 1 to 3 amino acid residues in length. In some embodiments, L1 is 5 to 10 amino acid residues in length, L2 is 5 to 8 amino acid residues in length, L3 is 1 to 5 amino acid residues in length, and L4 is 1 to 2 amino acid residues in length. In some embodiments, L1 is 7 amino acid residues in length, L2 is 5 amino acid residues in length, L3 is 1 amino acid residue in length, and L4 is 2 amino acid residues in length. In some embodiments, L1 is 10 amino acid residues in length, L2 is 10 amino acid residues in length, L3 is 0 amino acid residue in length, and L4 is 0 amino acid residues in length. In some embodiments, L1, L2, L3, and L4 each have an independently selected length from 0 to 15 amino acids (e.g., 0, 1, 2, 3, 4, 5, 6, 7, 8, 9, 10, 11, 12, 13, 14, or 15 amino acids), wherein at least two of the linkers have a length of 1 to 15 amino acids (e.g., 1, 2, 3, 4, 5, 6, 7, 8, 9, 10, 11, 12, 13, 14, or 15 amino acids). In some embodiments, L1, L2, L3, and L4 are Asp-Lys-Thr-His-Thr (SEQ ID NO: 21). In some embodiments, linker(s) comprise the sequence Gly-Gln-Pro-Lys-Ala-Ala-Pro (SEQ ID NO: 19). In some embodiments, L1 comprises the sequence Gly-Gln-Pro-Lys-Ala-Ala-Pro (SEQ ID NO: 19). In some embodiments, L1 comprises the sequence Gly-Gln-Pro-Lys-Ala-Ala-Pro (SEQ ID NO: 19), L2 comprises the sequence Thr-Lys-Gly-Pro-Ser-Arg (SEQ ID NO: 19), L3 comprises the sequence Ser, and L4 comprises the sequence Arg-Thr. In some embodiments, L3 comprises the sequence Gly-Gln-Pro-Lys-Ala-Ala-Pro (SEQ ID NO: 19). In some embodiments, L1 comprises the sequence Ser, L2 comprises the sequence Arg-Thr, L3 comprises the sequence Gly-Gln-Pro-Lys-Ala-Ala-Pro (SEQ ID NO: 19) and L4 comprises the sequence Thr-Lys-Gly-Pro-Ser-Arg (SEQ ID NO: 19).

In some embodiments, L1, L2, L3 and L4 each independently comprises a sequence selected from (Gly-Gly-Gly-Gly-Ser)$_n$ (wherein n is an integer between 0 and 5; SEQ ID NO: 23), Gly-Gly-Gly-Gly-Ser-Gly-Gly-Gly-Gly-Ser (SEQ ID NO: 10), Gly-Gly-Gly-Gly-Ser-Gly-Gly-Gly-Gly-Ser-Gly-Gly-Gly-Gly-Ser (SEQ ID NO: 11), Ser, Arg-Thr, Thr-Lys-Gly-Pro-Ser (SEQ ID NO: 13), Gly-Gln-Pro-Lys-Ala-Ala-Pro (SEQ ID NO: 19), and Gly-Gly-Ser-Gly-Ser-Ser-Gly-Ser-Gly-Gly (SEQ ID NO: 12). In some embodiments, L1 comprises the sequence Gly-Gln-Pro-Lys-Ala-Ala-Pro (SEQ ID NO: 19), L2 comprises the sequence Thr-Lys-Gly-Pro-Ser (SEQ ID NO: 13), L3 comprises the sequence Ser, and L4 comprises the sequence Arg-Thr. In some embodiments, L1 comprises the sequence Gly-Gly-Gly-Gly-Ser-Gly-Gly-Gly-Gly-Ser (SEQ ID NO: 10), L2 comprises the sequence Gly-Gly-Gly-Gly-Ser-Gly-Gly-Gly-Gly-Ser (SEQ ID NO: 10), L3 is 0 amino acids in length, and L4 is 0 amino acids in length. In some embodiments, L1 comprises the sequence Gly-Gly-Ser-Gly-Ser-Ser-Gly-Ser-Gly-Gly (SEQ ID NO: 12), L2 comprises the sequence Gly-Gly-Ser-Gly-Ser-Ser-Gly-Ser-Gly-Gly (SEQ ID NO: 12), L3 is 0 amino acids in length, and L4 is 0 amino acids in length. In some embodiments, L1 comprises the sequence Gly-Gly-Gly-Gly-Ser-Gly-Gly-Gly-Gly-Ser-Gly-Gly-Gly-Gly-Ser (SEQ ID NO: 11), L2 is 0 amino acids in length, L3 comprises the sequence Gly-Gly-Gly-Gly-Ser-Gly-Gly-Gly-Gly-Ser-Gly-Gly-Gly-Gly-Ser (SEQ ID NO: 11), and L4 is 0 amino acids in length. In some embodiments, L1 and L2 are zero amino acids in length, and L3 and L4 each comprise a sequence independently selected from (Gly-Gly-Gly-Gly-Ser)$_n$ (SEQ ID NO: 23) (wherein n is an integer between 0 and 5; SEQ ID NO: 23, Gly-Gly-Gly-Gly-Ser-Gly-Gly-Gly-Gly-Ser (SEQ ID NO: 10), Gly-Gly-Gly-Gly-Ser-Gly-Gly-Gly-Gly-Ser-Gly-Gly-Gly-Gly-Ser (SEQ ID NO: 11), Ser, Arg-Thr, Thr-Lys-Gly-Pro-Ser (SEQ ID NO: 13), Gly-Gln-Pro-Lys-Ala-Ala-Pro (SEQ ID NO: 19), and Gly-Gly-Ser-Gly-Ser-Ser-Gly-Ser-Gly-Gly (SEQ ID NO: 12). In some embodiments, L3 and L4 are zero amino acids in length, and L1 and L2 each comprise a sequence independently selected from (Gly-Gly-Gly-Gly-Ser)$_n$ (wherein n is an integer between 0 and 5; SEQ ID NO: 23), Gly-Gly-Gly-Gly-Ser-Gly-Gly-Gly-Gly-Ser (SEQ ID NO: 10), Gly-Gly-Gly-Gly-Ser-Gly-Gly-Gly-Gly-Ser-Gly-Gly-Gly-Gly-Ser (SEQ ID NO: 11), Ser, Arg-Thr, Thr-Lys-Gly-Pro-Ser (SEQ ID NO: 13), Gly-Gln-Pro-Lys-Ala-Ala-Pro (SEQ ID NO: 19), and Gly-Gly-Ser-Ser-Gly-Ser-Gly-Gly (SEQ ID NO: 12).

In some embodiments, linker(s) comprise a sequence derived from a naturally occurring sequence at the junction between an antibody variable domain and an antibody constant domain (e.g., as described in WO2012/135345). For example, in some embodiments, the linker comprises a sequence found at the transition between an endogenous VH and CH1 domain, or between an endogenous VL and CL domain (e.g., kappa or lambda). In some embodiments, the linker comprises a sequence found at the transition between an endogenous human VH and CH1 domain, or between an endogenous human VL and CL domain (e.g., human kappa or lambda).

The examples listed above are not intended to limit the scope of the disclosure in any way, and linkers comprising randomly selected amino acids selected from the group consisting of valine, leucine, isoleucine, serine, threonine, lysine, arginine, histidine, aspartate, glutamate, asparagine, glutamine, glycine, and proline are suitable for use in the binding proteins described herein. For additional descriptions of linker sequences, see, e.g., WO2012135345, WO2017/180913 incorporated by reference.

As used herein, the term "valency" refers to the number of binding sites of a binding protein, an epitope, an antigen-binding protein or an antibody. For example, the term "monovalent binding protein" refers to a binding protein that has one antigen binding site. The term "bivalent binding protein" refers to a binding protein that has two binding sites. The term "trivalent binding protein" refers to a binding protein that has three binding sites. The term "tetravalent binding protein" refers to a binding protein that has four binding sites. In particular embodiments the divalent binding protein can bind to one antigen target. In other embodiments, the divalent binding protein can bind to two different antigen targets. In particular embodiments the trivalent binding protein can bind to one antigen target, i.e., is monospecific. In other embodiments, the trivalent binding protein can bind to two different antigen targets, i.e., is bispecific. In other embodiments, the trivalent binding protein can bind to three different antigen targets, i.e., is trispecific. In particular embodiments the tetravalent binding protein can bind to one antigen target, i.e., is monospecific. In other embodiments, the tetravalent binding protein can bind to two different antigen targets, i.e., is bispecific. In other embodiments, the tetravalent binding protein can bind to three different antigen targets, i.e., is trispecific. In other embodiments, the tetravalent binding protein can bind to four different antigen targets, i.e., is tetraspecific.

As used herein, the term "specificity" refers to the number of binding specificities of a binding protein, an epitope, an antigen-binding protein or an antibody. For example, the term "monospecific binding protein" refers to a binding protein that specifically binds to one antigen target. The term "bispecific binding protein" refers to a binding protein that specifically binds to two different antigen targets. The term "trispecific binding protein" refers to a binding protein that specifically binds to three different antigen targets. The term "tetraspecific binding protein" refers to a binding protein that specifically binds to four different antigen targets and so forth.

As used herein, the term "selective recognition site" refers to a modification in the binding protein allowing to be selectively recognized by an affinity reagent binding to the selective recognition site. Examples of a selective recognition site comprise the binding site for protein A in the Fc part of an immunoglobulin.

As used herein, the term "affinity reagent" refers to a reagent that contains a ligand that is immobilized on a matrix and specifically binds to surface groupings of molecules such as amino acids or sugar side chains and usually have specific three-dimensional structural characteristics, as well as specific charge characteristics. Affinity reagents are tools in affinity chromatography, where purification is enabled by the specific interaction between the ligand and the product. "Protein L," which is an example of an affinity reagent, refers to recombinant protein L that is immobilized on a matrix to form a ligand that has affinity for a subset of the variable domain of immunoglobulin kappa light chains. Such matrices can be resin. Another example of an affinity reagent is "KappaSelect," which refers to a recombinant 13 kDa camelid-derived single chain antibody that is immobilized onto a matrix to form a ligand that has affinity for the constant domain of human immunoglobulin kappa light chains. Another example of an affinity reagent is Protein A. Protein A is a 42 kDa surface protein originally found in the cell wall of the bacteria *Staphylococcus aureus*. It has been shown via crystallographic refinement that the primary binding site for protein A is on the Fc region, between the CH2 and CH3 domains. In addition, protein A has been shown to bind human IgG molecules containing IgG F(ab')2 fragments from the human VH3 gene family. Protein A can bind with strong affinity to the Fc portion of immunoglobulin of certain species.

The dissociation constant ($K_D$) of a binding protein can be determined, for example, by surface plasmon resonance. Generally, surface plasmon resonance analysis measures real-time binding interactions between ligand (a target antigen on a biosensor matrix) and analyte (a binding protein in solution) by surface plasmon resonance (SPR) using the BIAcore system (Pharmacia Biosensor; Piscataway, N.J.). Surface plasmon analysis can also be performed by immobilizing the analyte (binding protein on a biosensor matrix) and presenting the ligand (target antigen). The term "$K_D$," as used herein, refers to the dissociation constant of the interaction between a particular binding protein and a target antigen.

As used herein, the term "specifically binds" refers to the ability of a binding protein or an antigen-binding fragment thereof to bind to an antigen containing an epitope with an Kd of at least about $1\times10^{-6}$ M, $1\times10^{-7}$ M, $1\times10^{-8}$ M, $1\times10^{-9}$ M, $1\times10^{-10}$ M, $1\times10^{-11}$ M, $1\times10^{-12}$ M, or more, and/or to bind to an epitope with an affinity that is at least two-fold greater than its affinity for a nonspecific antigen. Binding affinity of an antigen to a binding protein or an antibody can be conducted by surface plasmon resonance (SPR) using a BIAcore instrument.

As used herein, the term "reference Fab molecule" refers to a molecule that is identical to the pseudoFab molecule except that, in a pseudoFab molecule, CH1 and CL domains of the reference Fab molecule are replaced with VHX and VLX domains. The "reference Fab molecule" refers to a molecule wherein variable domains are identical to the variable domains of the pseudoFab and has CH1 and CL domains. In the pseudoFab molecule, CH1 and CL domains of the reference Fab molecule are replaced with VHX and VLX domains.

As used herein, the term "nucleic acid" refers to polymeric or oligomeric macromolecules, or large biological molecules, essential for all known forms of life. Nucleic acids, which include DNA (deoxyribonucleic acid) and RNA (ribonucleic acid), are made from monomers known as nucleotides. Most naturally occurring DNA molecules consist of two complementary biopolymer strands coiled around each other to form a double helix. The DNA strand is also known as polynucleotides consisting of nucleotides. Each nucleotide is composed of a nitrogen-containing nucleobase as well as a monosaccharide sugar called deoxyribose or ribose and a phosphate group. Naturally occurring nucleobases comprise guanine (G), adenine (A), thymine (T), uracil (U) or cytosine (C). The nucleotides are joined to one another in a chain by covalent bonds between the sugar of one nucleotide and the phosphate of the next, resulting in an alternating sugar-phosphate backbone. If the sugar is deoxyribose, the polymer is DNA. If the sugar is ribose, the polymer is RNA. Typically, a polynucleotide is formed through phosphodiester bonds between the individual nucleotide monomers.

As used herein, the term "polynucleotide" refers to single-stranded or double-stranded nucleic acid polymers of at least 10 nucleotides in length. It is understood that the nucleotides comprising the polynucleotide can be ribonucleotides or deoxyribonucleotides or a modified form of either type of nucleotide. Such modifications include base modifications such as bromuridine, ribose modifications such as arabinoside and 2',3'-dideoxyribose, and internucleotide linkage modifications such as phosphorothioate, phosphorodithioate, phosphoroselenoate, phosphorodiselenoate, phosphoroanilothioate, phoshoraniladate and phosphoroamidate. The term "polynucleotide" specifically includes single-stranded and double-stranded forms of DNA.

An "isolated polynucleotide" is a polynucleotide of genomic, cDNA, or synthetic origin or some combination thereof, which: (1) is not associated with all or a portion of a polynucleotide in which the isolated polynucleotide is found in nature, (2) is linked to a polynucleotide to which it is not linked in nature, or (3) does not occur in nature as part of a larger sequence.

An "isolated polypeptide" is one that: (1) is free of at least some other polypeptides with which it would normally be found, (2) is essentially free of other polypeptides from the same source, e.g., from the same species, (3) is expressed by a cell from a different species, (4) has been separated from at least about 50 percent of polynucleotides, lipids, carbohydrates, or other materials with which it is associated in nature, (5) is not associated (by covalent or noncovalent interaction) with portions of a polypeptide with which the "isolated polypeptide" is associated in nature, (6) is operably associated (by covalent or noncovalent interaction) with a polypeptide with which it is not associated in nature, or (7) does not occur in nature. Such an isolated polypeptide can be encoded by genomic DNA, cDNA, mRNA or other RNA, of synthetic origin, or any combination thereof. In exemplary embodiments, the isolated polypeptide is substantially free from polypeptides or other contaminants that are found in its natural environment that would interfere with its use (therapeutic, diagnostic, prophylactic, research or otherwise).

As used herein, the term "expression vector" also referred to as an expression construct, usually refers to a plasmid or virus designed for protein expression in cells. The term "vector" refers to a protein or a polynucleotide or a mixture thereof which is capable of being introduced or of introducing proteins and/or nucleic acids comprised therein into a cell. Examples of vectors include but are not limited to plasmids, cosmids, phages, viruses or artificial chromosomes. In particular, a vector is used to transport a gene product of interest, such as e.g., foreign or heterologous DNA into a suitable host cell. Vectors may contain "replicon" polynucleotide sequences that facilitate the autonomous replication of the vector in a host cell. Foreign DNA is defined as heterologous DNA, which is DNA not naturally found in the host cell, which, for example, replicates the vector molecule, encodes a selectable or screenable marker, or encodes a transgene. Once in the host cell, the vector can replicate independently of or coincidental with the host chromosomal DNA, and several copies of the vector and its inserted DNA can be generated. In addition, the vector can also contain the necessary elements that permit transcription of the inserted DNA into an mRNA molecule or otherwise cause replication of the inserted DNA into multiple copies of RNA. Vectors may further encompass "expression control sequences" that regulate the expression of the gene of interest. Typically, expression control sequences are polypeptides or polynucleotides such as but not limited to promoters, enhancers, silencers, insulators, or repressors. In a vector comprising more than one polynucleotide encoding for one or more gene products of interest, the expression may be controlled together or separately by one or more expression control sequences. More specifically, each polynucleotide comprised on the vector may be control by a separate expression control sequence or all polynucleotides comprised on the vector may be controlled by a single expression control sequence. Polynucleotides comprised on a single vector controlled by a single expression control sequence may form an open reading frame. Some expression vectors additionally contain sequence elements adjacent to the inserted DNA that increase the half-life of the expressed mRNA and/or allow translation of the mRNA into a protein molecule. Many molecules of mRNA and polypeptide encoded by the inserted DNA can thus be rapidly synthesized.

As used herein, the term "host cell" refers to a cell into which a recombinant expression vector has been introduced. A recombinant host cell or host cell is intended to refer not only to the particular subject cell, but also to the progeny of such a cell. Because certain modifications may occur in succeeding generations due to either mutation or environmental influences, such progeny may not, in fact, be identical to the parent cell, but such cells are still included within the scope of the term "host cell" as used herein. A wide variety of host cell expression systems can be used to express the binding proteins, including bacterial, yeast, baculoviral, and mammalian expression systems (as well as phage display expression systems). An example of a suitable bacterial expression vector is pUC19. To express a binding protein recombinantly, a host cell is transformed or transfected with one or more recombinant expression vectors carrying DNA fragments encoding the polypeptide chains of the binding protein such that the polypeptide chains are expressed in the host cell and, in exemplary embodiments, secreted into the medium in which the host cells are cultured, from which medium the binding protein can be recovered.

As used herein, the term "pharmaceutical composition" refers to a compound or composition capable of inducing a desired therapeutic effect when properly administered to a patient.

The term "pharmaceutically acceptable carrier" or "physiologically acceptable carrier," as used herein, refers to one or more formulation materials suitable for accomplishing or enhancing the delivery of a binding protein.

The terms "effective amount" and "therapeutically effective amount," when used in reference to a pharmaceutical composition comprising one or more binding proteins (e.g., antibodies or antigen-binding fragments thereof), refer to an amount or dosage sufficient to produce a desired therapeutic result. More specifically, a therapeutically effective amount is an amount of a binding protein (e.g., an antibody or antigen-binding fragment thereof) sufficient to inhibit, for some period of time, one or more of the clinically defined pathological processes associated with the condition being treated. The effective amount may vary depending on the specific antibody-like binding protein that is being used, and also depends on a variety of factors and conditions related to the patient being treated and the severity of the disorder. For example, if the binding protein or multispecific binding protein is to be administered in vivo, factors such as the age, weight, and health of the patient as well as dose response curves and toxicity data obtained in preclinical animal work would be among those factors considered. The determination of an effective amount or therapeutically effective amount of a given pharmaceutical composition is well within the ability of those skilled in the art.

As used herein, the term "method of production of a binding protein" refers to recombinant methods of protein expression using techniques well known in the art.

II. Pseudofab Moieties

In certain embodiments, a binding molecule described herein comprises at least one pseudoFab moiety. As used herein, a "pseudoFab" moiety is analogous to a Fab moiety of a conventional antibody in that it comprises a functional antigen binding portion formed by the pairing of a variable light chain (VL) domain with a variable heavy chain (VH). However, whereas the VL and VH domains of a conventional Fab are directly fused with or linked to a constant light chain (CL) domain and a constant heavy chain 1 (CH1) domain, respectively, a pseudoFab moiety lacks CH1 and CL domains. Instead, the VL and VH domains of the pseudoFab are operatively linked to a second pair of stabilized knockout VL and VH domains (denoted herein as VLX and VHX) which form an inactive or non-functional binding portion (herein, a "stabilized knockout" portion or domain) that it is incapable of specifically binding to a target antigen (e.g., any target antigen). In certain embodiments, the pseudoFab moiety is incapable of binding the target antigen of the corresponding Fab moiety from which it is derived. The pseudoFab moiety lacks CH and CL domains.

While unable to selectively bind a target antigen, the VLX and VHX domains of a pseudoFab nevertheless preferentially associate which each other to form a stable chain pairing. Therefore, by appending a pseudoFab to one or more additional binding domains of differing specificities, the inherent stability of the VLX/VHX chain pairing of a pseudoFab can drive heterodimerization of the chains of a desired multispecific binding molecule.

Accordingly, a pseudoFab of the present disclosure comprises or consists of a first polypeptide chain having a structure represented by the formula:

VHa-L1-VHX; or            (I)

VHb-L1-VHX            (II)

and second polypeptide chain having a structure represented by the formula:

VLa-L2-VLX; or            (III)

VLb-L2-VLX            (IV)

wherein

VHX associates with VLX to form a knockout domain,

VH associates with VL to form a first functional antigen binding domain, and

L1 and L2 are linkers, which may present or absent.

In certain embodiments, the first polypeptide chain of the pseudoFab has the structure VH-L1-VHX and the second polypeptide chain of the pseudoFab has the structure VL-L2-VLX.

In other embodiments, the first polypeptide of the pseudoFab has the structure VHX-L1-VH and the second polypeptide chain has the structure VLX-L2-VL.

In some embodiments, the binding protein comprises separate proteins chains selected from one of the following group:

(a) VHa-CH1-L1-VHb-L2-VHX and VLa-CL and VLb-L3-VLX;

(b) VHa-L2-VHX-L1-VHb-CH1 and VLa-L3-VLX and VLb-CL;

(c) VHa-CH1-L1-VHa-CH1 and VHb-L2-VHX-L3-VHb-L4-VHX and two chains VLb-L5-VLX and two chains VLa-CL;

wherein the chains of (a) and (b) can be present once or twice, and wherein L1, L2, L3, L4 and L5 are linkers, which may independently be the same or different.

(a) Knockout Domains

The "knockout" domain of a pseudoFab can be generated by any means which results in abrogation or decrease of the binding affinity or specificity of a normally functional antigen binding site. In certain embodiments, the knockout domain of the pseudoFab has been rendered inactive or non-functional by one or mutations in one or both of the VLX and VHX domains of the knockout domain. In one embodiment, a knockout modification is an amino acid substitution. In other embodiments, a knockout modification is an amino acid insertion or deletion. In another embodiment, a knockout modification is a combination of one or more amino acid substitutions, amino acid insertions and amino acid deletions. In yet other embodiments, the knockout domain is rendered non-functional by covalent modification with, for example, a moiety which interferes with the ability of a variable domain to bind a target antigen.

In certain embodiments, the knockout modification abolishes binding by creating repulsion or disruption of stabilized antigen-binding protein complexes. In certain embodiments, the knockout modification may comprise replacing a residue which normally forms a contact with the target antigen with an amino acid that creates charge-charge repulsion with the target antigen. Additionally or alternatively, mutations which destabilize complexes of pi-pi interactions can be introduced.

In certain embodiments, the knockout modification is the substitution of a charged amino acid with an uncharged amino acid. In other embodiments, the knockout modification is the substitution of an uncharged amino acid with a charged amino acid. In other embodiments, the knockout modification is the substitution of a polar amino acid with a non-polar amino acid. In other embodiments, the knockout modification is the substitution of charged amino acids by polar and uncharged amino acids and polar uncharged amino acids with non-polar hydrophobic amino acids.

In certain embodiments, the knockout modification is introduced at an amino acid position which forms a binding interaction with an antigen. For example, the knockout modification may be located on the protein surface where an antigen-antibody interaction normally occurs. In certain exemplary embodiments, the modifications can be introduced in the complementary determining regions (CDR) of one or both VLX or VHX domains.

In certain embodiments, the knockout modification is a substitution of a residue in CDRH1 of the VHX domain. In another embodiment, the knockout modification is a substitution of a residue in CDRH2 of the VHX domain. In another embodiment, the knockout modification is a substitution of a residue in CDRH3 of the VHX domain.

In certain embodiments, the knockout modification is a substitution of a residue in CDRL1 of the VLX domain. In another embodiment, the knockout modification is a substitution of a residue in CDRL2 of the VLX domain. In another embodiment, the knockout modification is a substitution of a residue in CDRL3 of the VLX domain.

In certain exemplary embodiments, an arginine in the CDR of the VHX or VLX domains is mutated to glutamate. In other embodiments, one or more tyrosines in the CDR of the VHX or VLX domain is mutated to alanine.

In certain embodiments, the modification results in a knockout domain that is completely devoid the target antigen binding activity of the functional, non-knockout (i.e., wild-type) counterpart from which it is derived. Alternatively, the binding functionality of the knockout domain may be substantially reduced as compared to its functional, non-knockout counterpart, while nevertheless retaining some level of detectable binding.

Scaffolds for generating knockout domains can be obtained for example from the Protein Data Bank (PDB). The PDB is a crystallographic database for the three-dimensional structural data of large biological molecules, such as proteins and nucleic acids. Knockout domains can be generated by specifically mutating amino acids which are predicted to be involved in antigen binding by computer based modeling of antigen binding domain and its cognate target antigen. Subsequent binding studies can be conducted by using methods known in the art, e.g., surface plasmon resonance, and reveal with high accuracy whether the binding function is abolished and interaction between the binding domain and its target are disrupted.

(b) Stabilized Knockout Domains

In certain embodiments, the knockout domain is a stabilized knockout domain having increased thermal stability as compared to its wild-type counterpart. For example, in certain exemplary embodiments, the melting temperature ($T_m$) of the knockout domain is within at least 0.25° C., at least 0.5° C., at least 0.75° C., at least 1° C., at least 2° C., at least 3° C., at least 4° C., at least 5° C., or at least 10° C. as compared to the wild-type counterpart from which it is derived. In other exemplary embodiments, the $T_m$ of the knockout domain in increased with respect to its wild-type counterpart. For example, the $T_m$ may be increase at least 0.25° C., at least 0.5° C., at least 0.75° C., at least 1° C., at least 2° C., at least 3° C., at least 4° C., at least 5° C., or at least 10° C. as compared to the wild-type counterpart from which it is derived. Thermal stability may be measured by differential scanning fluorimetry (DSF) or other bioanalytic methods routinely used by those of skill in the art.

In certain embodiments, the pseudoFab comprises an engineered intrachain disulfide bond between the VHX or VLX domains of the knockout domain of the pseudoFab which confers enhanced stability. Typically, this modification is the substitution of at least one amino acid of the VHX domain with a cysteine (Cys) residue and at least one amino acid in the VLX domain with a Cys residue. The Cys residues may be introduced at positions of the VHX and VLX domains which allow formation of a disulfide bond after dimer formation. In certain embodiments, mutations may be made in the VH and VL interface to improve stability between the VH/VL interface. Specific sets of amino acid mutations in the VH domain and the VL domains may improve stability through the introduction of non-native cysteine residues that form disulfide bridges.

A first set of disulfide-stabilizing mutations may be made to amino acid residues in the VH and VL domains. In an exemplary embodiment, a disulfide bond is formed by a Cys at position 44 of the VHX domain and a Cys at position 100 of the VLX domain. This set of disulfide stabilizing mutations may be alternatively referred to as the "VH44C/VL100C" mutation set. The first set of disulfide stabilizing mutations are described in further detail in Reiter et al. Nature Biotechnology. Vol. 14. Pg. 1239-1245. 1996, incorporated herein by reference for all purposes.

A second set of disulfide stabilizing mutations may be made to amino acid residues in the VH and VL domain. In an exemplary embodiment, a disulfide bond is formed by a Cys at position 105 of the VHX domain and a Cys at position 43 of the VLX domain. The second set of disulfide stabilizing mutations may be alternatively referred to as the "VH105C/VL43C" mutation set. Other disulfide stabilizing mutations are described in further detail in U.S. Pat. No. 9,527,927, which is incorporated herein by reference for all purposes.

In certain embodiments, the VLX domain of the pseudoFab comprises a variant of SEQ ID NO: 1 having at least one knockout modification. For example, the VLX domain may comprise an amino acid sequence that is at least 85%, at least 90%, at least 91%, at least 92%, at least 93%, at least 94%, at least 95%, at least 96%, at least 97%, at least 98%, or at least 99%, or 100% identical to the amino acid sequence of SEQ ID NO: 1, but for comprising the knockout modification.

In certain embodiments, the VHX domain of the pseudoFab comprises a variant of SEQ ID NO: 2 having at least one knockout modification. For example, the VHX domain may comprise an amino acid sequence that is at least 85%, at least 90%, at least 91%, at least 92%, at least 93%, at least 94%, at least 95%, at least 96%, at least 97%, at least 98%, or at least 99%, or 100% identical to the amino acid sequence of SEQ ID NO: 2, but for the knockout modification.

In one embodiment, the VLX domain of the pseudoFab comprises an amino acid sequence of SEQ ID NO: 76 and the VHX domain of the pseudoFab comprises an amino acid sequence selected from the group of SEQ ID NO: 77, SEQ ID NO: 78 and SEQ ID NO: 79.

II. Multispecific Pseudofab-Containing Binding Polypeptides

In other aspects, multispecific binding proteins comprising a pseudoFab moiety described herein are provided. The highly modular nature of the pseudoFab moiety allows for a wide variety of multispecific structures to be formed.

In certain embodiments, the multispecific binding proteins of the disclosure comprise additional binding specificities appended to the N-terminus and/or C-terminus of one or both chains of a pseudoFab moiety to form a multivalent pseudoFab-containing binding protein.

In some embodiments, a multispecific binding protein comprises:
 a) a first pseudoFab portion comprising:
  (1) a first VL domain (VLa) paired with a first VH domain (VHa) to form a first antigen binding site that binds target antigen A;
  (2) a first stabilized knockout VL domain (VLX) paired with a first stabilized knockout VH domain (VHX) to form a first disulfide stabilized knockout (dsKO) domain;
  (3) a first heterodimerization domain (HD1);
 wherein the first dsKO domain comprises (i) one or more inactivating mutations which abolish its binding to a target antigen; and (ii) one or more engineered interchain disulfide bonds;
 b) a first Fab portion comprising
  (1) a second VL domain (VLb) paired with second VH domain (VHb) to form a second functional antigen binding site that binds target antigen B;
  (2) a first CH1 domain paired with a first CL domain; and
  (3) a second heterodimerization domain (HD2).

In some embodiments, the first and second heterodimerization domains of the binding protein comprise first and second Fc domains. In some embodiments, the Fc domains comprise the general structure hinge-CH2 domain-CH3 domain.

(a) Fc-Heterodimerization Domains

In certain embodiments the multispecific binding proteins of the disclosure may further comprises a Fc-heterodimerization C1 or C2 domain. In some embodiments, the Fc-heterodimerization domain is selected from the group consisting of a heterodimerizing Fc or fragments thereof, in particular a knob-in-hole (KIH) variant of a Fc-part and effector-modified variants thereof or a heterodimerizing Fc or fragments thereof, in particular an EV-RWT variant of a Fc and effector-modified variants thereof. In some embodiments the Fc comprises one or more amino acid mutations. One possibility is removing a selective recognition site for a first affinity reagent, e.g., by mutations selected from the group consisting of H435R, Y436F and introducing a selective recognition site for a second affinity reagent. Alternatively, solely a selective recognition site for a second affinity reagent can be introduced.

(b) Homodimerization Domains

In certain embodiments the multispecific binding proteins of the disclosure may further comprise a homodimerization domain. In some embodiments the homodimerization domain is selected from the group consisting of an Fc region and effector-modified variants thereof; one or more CH2 domains, e.g., of IgG, IgE or IgM; one or more CH3 domains, e.g., of IgG, IgA or IgD; and one or more CH4 domains, e.g., of IgE or IgM.

III. Multimeric Pseudofab-Containing Binding Proteins (a) Symmetrical Tetravalent Constructs In another embodiment, the binding polypeptide comprises a pseudo Fab containing binding protein comprising additional polypeptide chains which associate with the polypeptide chains of a pseudoFab to form additional binding domains. These pseudo Fab containing binding polypeptides are further fused to an Fc heterodimerization domain to form a one half of conventional Y-shaped antibody.

In some embodiments, an antigen binding protein comprises six polypeptide chains that form four antigen-binding sites, wherein
(a) the first and second polypeptides comprise a structure represented by the formula:

VLa-L1-VLX [I] and [II]

b) the third and fourth polypeptides comprise a structure represented by the formula:

VLb-CL [III] and [IV]

(c) the fifth polypeptide comprises a structure represented by the formula:

VHa-L2-VHX-L3-VHb-CH1-FC1 [V]

(d) the sixth polypeptide comprises a structure represented by the formula:

VHa-L2-VHX-L3-VHb-CH1-FC2 [VI]

wherein:
VLa is a first immunoglobulin light chain variable domain;
VLb is a second immunoglobulin light chain variable domain;
VHa is a first immunoglobulin heavy chain variable domain;
VHb is a second immunoglobulin heavy chain variable domain;
VLX is a stabilized knockout light chain variable domain;
VHX is a stabilized knockout heavy chain variable domain;
CL is an immunoglobulin light chain constant domain;
CH1 is an immunoglobulin heavy chain constant domain;
FC1 and FC2 are Fc domains comprising an immunoglobulin hinge region and CH2 and CH3 immunoglobulin heavy chain constant domains; and
L1, L2 and L3 are amino acid linkers,
wherein
(1) the first VL domain (VLa) is paired with the first VH domain (VHa) to form a first functional antigen binding site that binds target antigen A;
(2) the second VL domain (VLb) is paired with the second VH domain (VHb) to form a second functional antigen binding site that binds target antigen B;
(3) the stabilized knockout VL domain (VLX) is paired with the stabilized knockout VH domain (VHX) to form a disulfide stabilized knockout (dsKO) domain;
wherein the dsKO domains comprise (i) one or more inactivating mutations which abolish its binding to a target antigen; and (ii) one or more engineered interchain disulfide bonds.

Figures 10A, 10B:
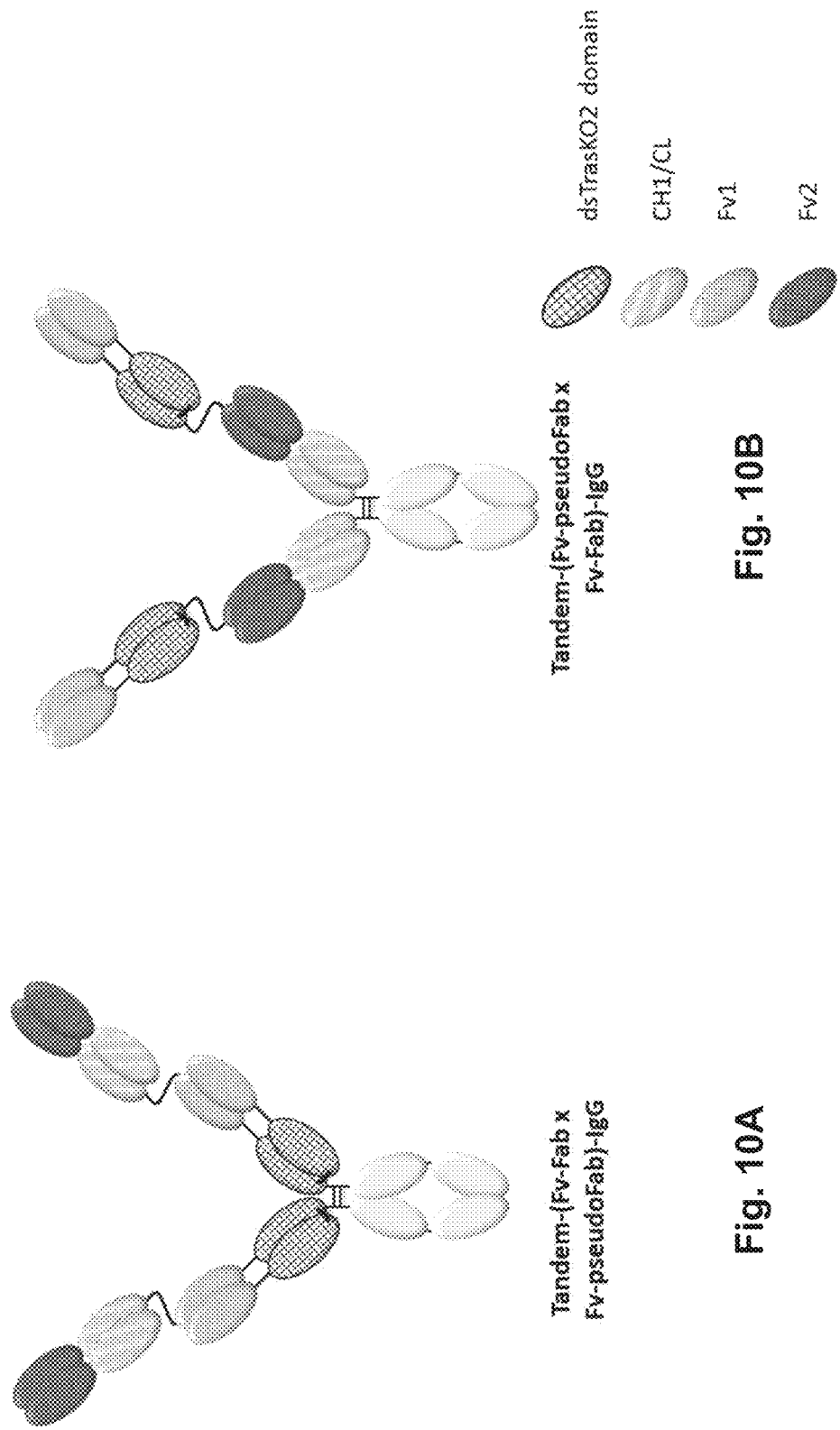
FIG. 10A-10B schematically depict dimeric bispecific tandem molecules comprising pseudoFab fragments with replacement of a CH1/CL pair with a disulfide stabilized Knockout domain (dsKO). Tandem-(Fv-Fab×Fv-pseudo-Fab)-IgG molecule is depicted in FIG. 10A, and a Tandem-(Fv-pseudoFab×Fv-Fab)-IgG molecule is depicted in FIG. 10B.
Figure 13C:
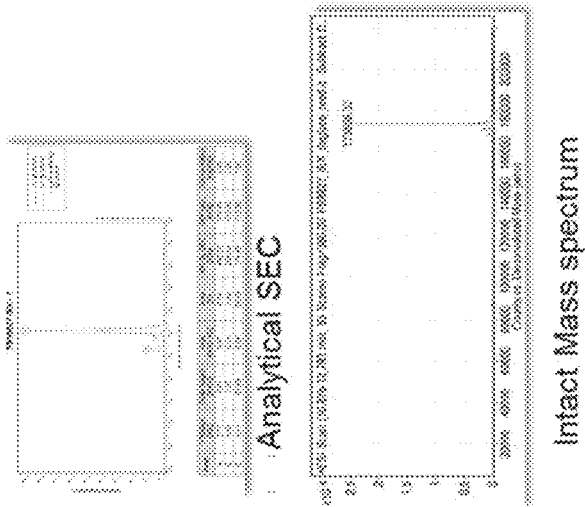
FIG. 13A-FIG. 13D depict a representative trispecific CODV IgG design in which a first pseudoFab comprising a Fv3 domain (having binding specificity for a first Target Antigen A, i.e., CD137) and a dsTrasKO domain is paired with a CODV arm (having a binding specificity (Fv1) for a second Target antigen B, i.e., Ox40 and a binding specificity (Fv2) for a third Target Antigen C, i.e., PD1).
Figure 13D:
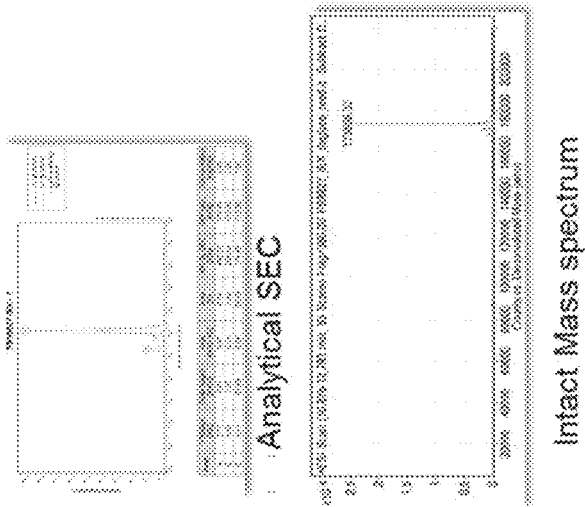
Figure 13B:
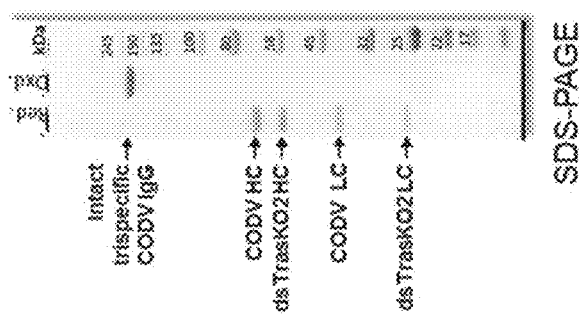
Figure 13A:
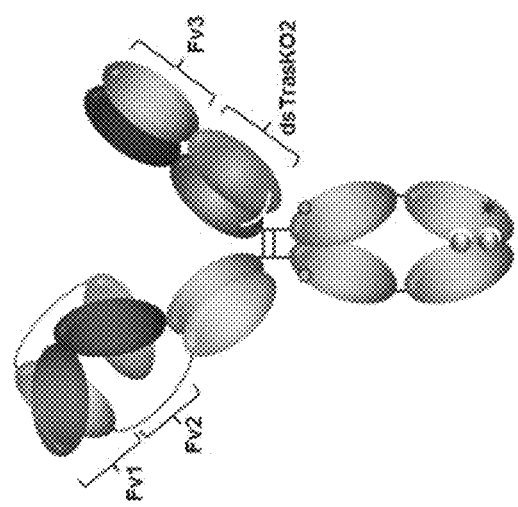

These molecules may also be referred to as a "Tandem-(Fv-pseudo Fab×Fv-Fab)" (see FIG. 10B).

In some embodiments, an antigen binding protein comprises six polypeptide chains that form four antigen-binding sites, wherein
(a) the first and second polypeptides comprise a structure represented by the formula:

VLa-L1-VLX [I] and [II]

(b) the third and fourth polypeptides comprise a structure represented by the formula:

VLb-CL [III] and [IV]

(c) the fifth polypeptide comprises a structure represented by the formula:

VHb-CH1-L3-VHa-L2-VHX-FC1 [V]

(d) the sixth polypeptide comprises a structure represented by the formula:

VHb-CH1-L3-VHa-L2-VHX-FC2 [VI]

wherein:
VLa is a first immunoglobulin light chain variable domain;
VLb is a second immunoglobulin light chain variable domain;
VHa is a first immunoglobulin heavy chain variable domain;
VHb is a second immunoglobulin heavy chain variable domain;
VLX is a stabilized knockout light chain variable domain;
VHX is a stabilized knockout heavy chain variable domain;
CL is an immunoglobulin light chain constant domain;
CH1 is an immunoglobulin heavy chain constant domain;
FC1 and FC2 are Fc domains comprising an immunoglobulin hinge region and CH2 and CH3 immunoglobulin heavy chain constant domains; and
L1, L2 and L3 are amino acid linkers,
wherein
(1) the first VL domain (VLa) is paired with the first VH domain (VHa) to form a first functional antigen binding site that binds target antigen A;
(2) the second VL domain (VLb) is paired with the second VH domain (VHb) to form a second functional antigen binding site that binds target antigen B;
(3) the stabilized knockout VL domain (VLX) is paired with the stabilized knockout VH domain (VHX) to form a disulfide stabilized knockout (dsKO) domain;
wherein the dsKO domains comprise (i) one or more inactivating mutations which abolish its binding to a target antigen; and (ii) one or more engineered interchain disulfide bonds.

These molecules may also be referred to as a "Tandem-(Fv-Fab×Fv-pseudoFab-IgG) (see FIG. 10A).

(b) Asymmetrical Tetraspecific Molecules

Dimerization of binding polypeptides wherein only one contains pseudoFab lead to asymmetrical constructs with additional specificities. These pseudoFab containing binding polypeptides are further fused to an Fc heterodimerization domain to form a one-half of conventional full-length Y-shaped IgG antibody.

In some embodiments, a multispecific binding protein comprises four polypeptide chains that form at least two antigen-binding sites, wherein
(a) a first polypeptide comprises a structure represented by the formula:

VLa-L1-VLX [I]

(b) a second polypeptide comprises a structure represented by the formula:

VHa-L2-VHX-FC1 [II]

(c) a third polypeptide comprises a structure represented by the formula:

VLb-CL [III]

(d) a fourth polypeptide comprises a structure represented by the formula:

VHb-CH1-FC2  [IV]

wherein:
VLa is a first immunoglobulin light chain variable domain;
VLb is a second immunoglobulin light chain variable domain;
VHa is a first immunoglobulin heavy chain variable domain;
VHb is a second immunoglobulin heavy chain variable domain;
VLX is a stabilized knockout light chain variable domain;
VHX is a stabilized knockout heavy chain variable domain;
CL is an immunoglobulin light chain constant domain;
CH1 is an immunoglobulin CH1 heavy chain constant domain;
FC1 and FC2 are Fc domains comprising an immunoglobulin hinge region and CH2 and CH3 immunoglobulin heavy chain constant domains; and
L1 and L2 are amino acid linkers, which may independently be the same or different,
wherein
(1) the first VL domain (VLa) is paired with a first VH domain (VHa) to form a first functional antigen binding site that binds target antigen A;
(2) the second VL domain (VLb) is paired with a second VH domain (VHb) to form a second functional antigen binding site that binds target antigen B;
(3) the stabilized knockout VL domain (VLX) is paired with the stabilized knockout VH domain (VHX) to form a disulfide stabilized knockout (dsKO) domain;
wherein the dsKO domain comprises (i) one or more inactivating mutations which abolish its binding to a target antigen; and (ii) one or more engineered interchain disulfide bonds.

Figure 2:
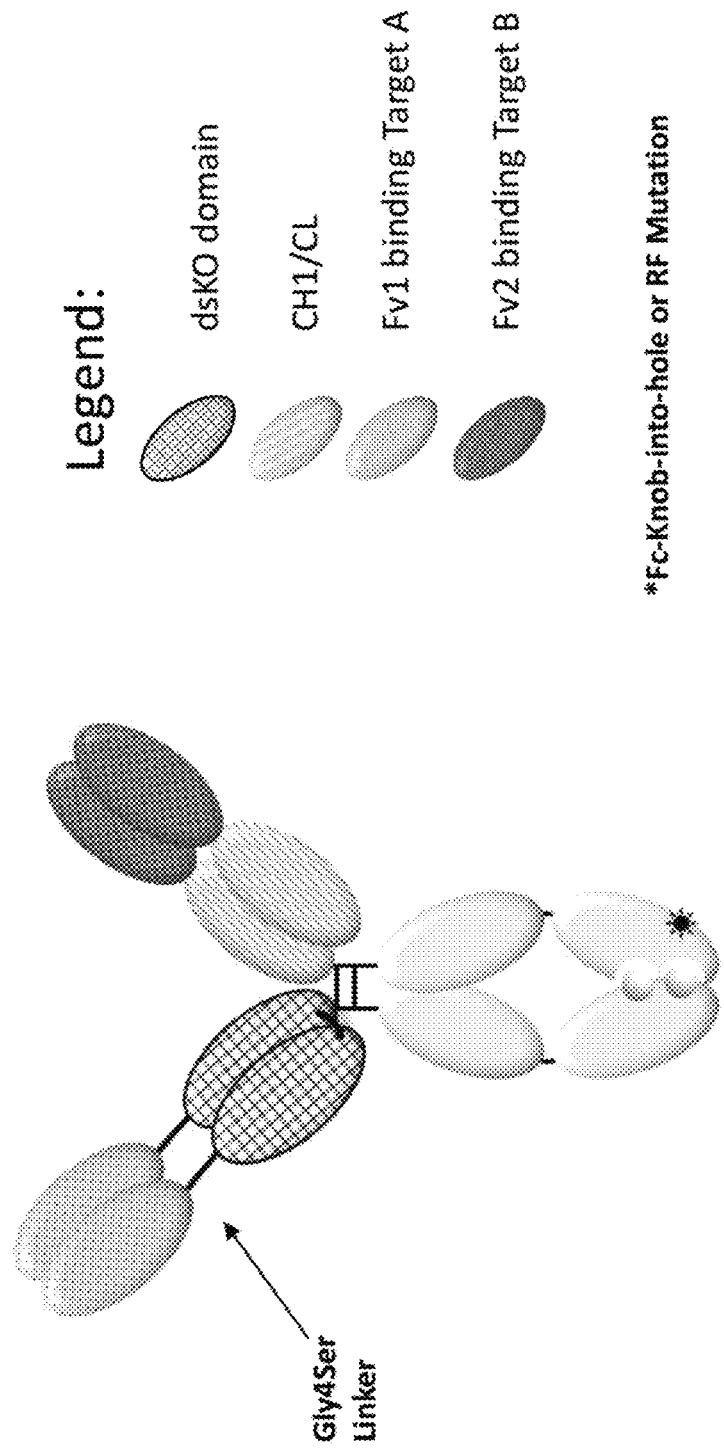
FIG. 2 schematically depicts an exemplary dimeric bispecific IgG molecule ((Fv-pseudoFab)×(Fv-Fab)-Fc)). A disulfide stabilized knockout domain (dsKO) replaces the CH/CL domains of one Fab arm of the IgG molecule. Peptide linkers (e.g., G4S or (G4S)2) link a first antigen binding site (Fv) to the dsKO domain to form a pseudoFab portion which binds antigen Target A. An Fc heterodimerization domain with knob-into-hole (KIH) or RF mutations links the pseudoFab portion with a second Fab binding arm that binds antigen Target B.
Figure 4:
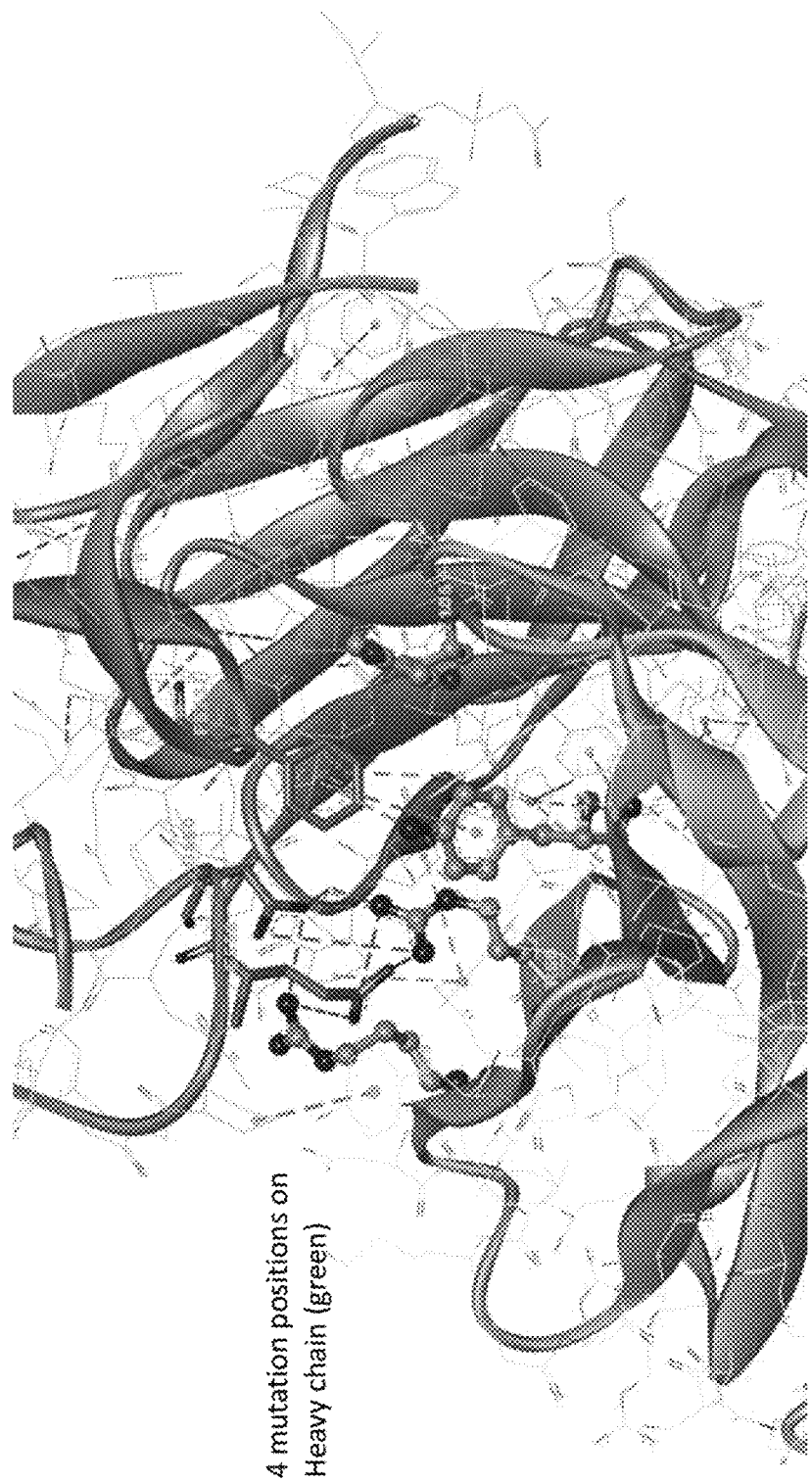
FIG. 4 schematically depicts the PDB structure 1N8Z of trastuzumab binding to HER2. The location of the four inactivating mutations which abolish binding to HER2 (R50, R59, Y33, and Y103) are noted.

These molecules may also be referred to as Dimeric Bispecific IgG molecules (Fv-pseudoFab)×(Fv-Fab)-Fc (see FIGS. 2 and 7).

In another embodiment, the binding polypeptide comprises a pseudo Fab-containing binding protein comprising additional polypeptide chains which associate with the polypeptide chains of a pseudoFab to form additional binding domains. These pseudoFab-containing binding polypeptides are further fused to an Fc heterodimerization domain to form a one-half of a conventional Y-shaped antibody. Dimerization of such molecules leads to constructs with additional specificities.

In some embodiments, an antigen binding protein comprises six polypeptide chains that form four antigen-binding sites, wherein
(a) the first and second polypeptides comprise a structure represented by the formula:

VLa-L1-VLX  [I] and [II]

(b) the third and fourth polypeptides comprise a structure represented by the formula:

VLb-CL  [III] and [IV]

(c) the fifth polypeptide comprises a structure represented by the formula:

VHa-L2-VHX-L3-VHa-L4-VHX-FC1  [V]

(d) the sixth polypeptide comprises a structure represented by the formula:

VHb-CH1-L5-VHb-CH1-FC2  [VI]

wherein:
VLa is a first immunoglobulin light chain variable domain;
VLb is a second immunoglobulin light chain variable domain;
VHa is a first immunoglobulin heavy chain variable domain;
VHb is a second immunoglobulin heavy chain variable domain;
VLX is a stabilized knockout light chain variable domain;
VHX is a stabilized knockout heavy chain variable domain;
CL is an immunoglobulin light chain constant domain;
CH1 is an immunoglobulin heavy chain constant domain;
FC1 and FC2 are Fc domains comprising an immunoglobulin hinge region and CH2 and CH3 immunoglobulin heavy chain constant domains; and
L1, L2, L3, L4 and L5 are amino acid linkers,
wherein
(1) the first VL domain (VLa) is paired with the first VH domain (VHa) to form a first functional antigen binding site that binds target antigen A;
(2) the second VL domain (VLb) is paired with the second VH domain (VHb) to form a second functional antigen binding site that binds target antigen B;
(3) the stabilized knockout VL domain (VLX) is paired with the stabilized knockout VH domain (VHX) to form a disulfide stabilized knockout (dsKO) domain;
wherein the dsKO domains comprise (i) one or more inactivating mutations which abolish its binding to a target antigen; (ii) one or more engineered interchain disulfide bonds.

The C-terminal heterodimerization domain can be a conventional Fc-Knob-into-hole heterodimerization domain, a conventional Fc-RF heterodimerization domain or combinations thereof. These molecules may also be referred to as "Fv-pseudoFab([HC]-(Fv-pseudoFab))×((Fv-Fab)[HC]-(Fv-Fab)))-Fc" (see FIG. 11).

In some embodiments, an antigen binding protein comprises four polypeptide chains that form three antigen-binding sites, wherein:
(a) the first polypeptide comprises a structure represented by the formula:

VLa-L1-VLX  [I]

(b) the second polypeptide comprises a structure represented by the formula:

VHa-L2-VHX-FC1  [II]

(c) the third polypeptide comprises a structure represented by the formula:

VLb-L3-VLc-L4-CL  [III]

(d) the fourth polypeptide comprises a structure represented by the formula:

VHc-L5-VHb-L6-CH1-FC2  [IV]

wherein:
VLa is a first immunoglobulin light chain variable domain;
VLb is a second immunoglobulin light chain variable domain;

VLc is a third immunoglobulin light chain variable domain;
VHa is a first immunoglobulin heavy chain variable domain;
VHb is a second immunoglobulin heavy chain variable domain;
VHc is a third immunoglobulin heavy chain variable domain;
CL is an immunoglobulin light chain constant domain;
CH1 is an immunoglobulin CH1 heavy chain constant domain;
VLX is a stabilized knockout light chain variable domain;
VHX is a stabilized knockout heavy chain variable domain;
FC1 and FC2 are Fc domains comprising an immunoglobulin hinge region and CH2 and CH3 immunoglobulin heavy chain constant domains; and
L1, L2, L3, L4, L5 and L6 are amino acid linkers,
wherein
(1) the first VL domain (VLa) is paired with the first VH domain (VHa) to form a first functional antigen binding site that binds target antigen A;
(2) the second VL domain (VLb) is paired with the second VH domain (VHb) to form a second functional antigen binding site that binds target antigen B;
(3) the third VL domain (VLc) is paired with the third VH domain (VHc) to form a third functional antigen binding site that binds target antigen C;
(4) the polypeptide of formula III and the polypeptide of formula IV form a cross-over light chain-heavy chain pair (CODV);
(5) the stabilized knockout VL domain (VLX) is paired with the stabilized knockout VH domain (VHX) to form a disulfide stabilized knockout (dsKO2) domain;
wherein the dsKO domain comprises (i) one or more inactivating mutations which abolish its binding to a target antigen; and (ii) one or more engineered interchain disulfide bonds.

In some embodiments, an antigen binding protein comprises four polypeptide chains that form three antigen-binding sites, wherein:
(a) the first polypeptide comprises a structure represented by the formula:

VLa-L1-VLX [I]

(b) the second polypeptide comprises a structure represented by the formula:

VHa-L2-VHX-FC1 [II]

(c) the third polypeptide comprises a structure represented by the formula:

VLb-L3-VLc-L4-CL [III]

(d) the fourth polypeptide comprises a structure represented by the formula:

VHc-L5-VHb-L6-CH1-FC2 [IV]

wherein:
VLa is a first immunoglobulin light chain variable domain;
VLb is a second immunoglobulin light chain variable domain;
VLc is a third immunoglobulin light chain variable domain;
VHa is a first immunoglobulin heavy chain variable domain;
VHb is a second immunoglobulin heavy chain variable domain;
VHc is a third immunoglobulin heavy chain variable domain;
CL is an immunoglobulin light chain constant domain;
CH1 is an immunoglobulin CH1 heavy chain constant domain;
VLX is a stabilized knockout light chain variable domain;
VHX is a stabilized knockout heavy chain variable domain;
FC1 and FC2 are Fc domains comprising an immunoglobulin hinge region and CH2 and CH3 immunoglobulin heavy chain constant domains; and
L1, L2, L3, L4, L5 and L6 are amino acid linkers, wherein
(1) the first VL domain (VLa) is paired with the first VH domain (VHa) to form a first functional antigen binding site that binds target antigen A;
(2) the second VL domain (VLb) is paired with the second VH domain (VHb) to form a second functional antigen binding site that binds target antigen B;
(3) the third VL domain (VLc) is paired with the third VH domain (VHc) to form a third functional antigen binding site that binds target antigen C;
(4) the polypeptide of formula III and the polypeptide of formula IV form a cross-over light chain-heavy chain pair (CODV);
(5) the stabilized knockout VL domain (VLX) is paired with the stabilized knockout VH domain (VHX) to form a disulfide stabilized knockout (dsKO2) domain;
wherein the dsKO domain comprises (i) one or more inactivating mutations which abolish its binding to a target antigen of a reference Fab molecule; and (ii) one or more engineered interchain disulfide bonds.

These molecules may also be referred to as "(CODV-Fab)×(pseudoFab)-Fc" (see FIG. 13).

In particular embodiments of the first and second aspects of the present invention, the binding protein comprises a light chain and heavy chain pair selected from the group consisting of SEQ ID NO: 6 and 7; SEQ ID NO: 8 and 9; SEQ ID NO: 10 and 11; SEQ ID NO: 12 and 13; SEQ ID NO: 14 and 15; SEQ ID NO: 16 and 17; SEQ ID NO: 18 and 19; SEQ ID NO: 20 and 21; SEQ ID NO: 22 and 23; SEQ ID NO: 24 and 25; SEQ ID NO: 26 and 27; SEQ ID NO: 28 and 29; SEQ ID NO: 30 and 31; SEQ ID NO: 32 and 33; SEQ ID NO: 34 and 35; SEQ ID NO: 36 and 37; SEQ ID NO: 38 and 39; SEQ ID NO: 40 and 41; SEQ ID NO: 42 and 43; SEQ ID NO: 44 and 45; SEQ ID NO: 46 and 47 and SEQ ID NO: 48 and 49; SEQ ID NO: 50 and 51; SEQ ID NO: 52 and 53 and SEQ ID NO: 54 and 55; SEQ ID NO: 56 and 57 and SEQ ID NO: 58 and 59; SEQ ID NO: 60 and 61 and SEQ ID NO: 62 and 63; SEQ ID NO: 64 and 65 and SEQ ID NO: 66 and 67; SEQ ID NO: 68 and 69 and SEQ ID NO: 70 and 71; SEQ ID NO: 72 and 73; and SEQ ID NO: 74 and 75.

In some embodiments, the first and second CL are independently selected from the group consisting of constant region light chain kappa (CLK) and constant region light chain lambda (CLX).

In some embodiments, the HD1 and HD2 each comprise a Fc-region and effector-modified variants thereof; a heterodimerizing Fc-part, in particular a knob-in-hole (KIH) variant of a Fc-part and effector-modified variants thereof; one or more CH2 domains, e.g., of IgG, IgE or IgM, one or more CH3 domains, e.g., of IgG, IgA or IgD, or one or more CH4 domains, e.g., of IgE or IgM.

In some embodiments, one of the Fc domains comprises a first CH3 domain comprising one or both of S354C and T366W mutations, and the other Fc domain comprises a second CH3 domain comprising one or both of Y349C, T366S, L368A, and Y407V mutations.

In one embodiment the Fc region of HD1 or HD2 comprises one or more amino acid mutations which lead to removing a selective recognition site for a second affinity reagent, e.g., selected from the group consisting of H435R or Y436F, or lead to introducing a selective recognition site for a third affinity reagent.

TABLE 2

| | Sequences of selected binding proteins | |
|---|---|---|
| ID | Sequence | Annotation: |
| | DIQMTQSPSSLSASVGDRVTITCRASQDVNTAVAWYQQKPGKAPKLLIYSA SFLYSGVPSRFSGSRSGTDFTLTISSLQPEDFATYYCQQHYTTPPTFGQGT KVEIK | Variable light chain sequence of Trastuzumab SEQ ID NO: 1 |
| | EVQLVESGGGLVQPGGSLRLSCAASGFNIKDTYIHWVRQAPGKGLEWVARI YPTNGYTRYADSVKGRFTISADTSKNTAYLQMNSLRAEDTAVYYCSRWGG DGFYAMDYWGQGTLVTVSS | Variable heavy chain sequence of Trastuzumab SEQ ID NO: 2 |
| Var. 1 | EVQLVESGGGLVQPGGSLRLSCAASGFNIKDTAIHWVRQAPGKGLEWVAEIYPT NGYTEYADSVKGRFTISADTSKNTAYLQMNSLRAEDTAVYYCSRWGGDGFAAMD YWGQGTLVTVSS | Variable heavy chain sequence of trastuzumab variant 1. SEQ ID NO: 3 |
| Var. 2 | EVQLVESGGGLVQPGGSLRLSCAASGFNIKDTYIHWVRQAPGKGLEWVAEIYPT NGYTEYADSVKGRFTISADTSKNTAYLQMNSLRAEDTAVYYCSRWGGDGFYAMD YWGQGTLVTVSS | Variable heavy chain sequence of trastuzumab variant 2. SEQ ID NO: 4 |
| Var. 3 | EVQLVESGGGLVQPGGSLRLSCAASGFNIKDTAIHWVRQAPGKGLEWVARIYPT NGYTRYADSVKGRFTISADTSKNTAYLQMNSLRAEDTAVYYCSRWGGDGFAAMD YWGQGTLVTVSS | Variable heavy chain sequence of trastuzumab variant 3. SEQ ID NO: 5 |
| 1 | DIVLTQSPASLAVSLGQRATISCRASESVDSYGQSYMHWYQQKAGQPPKLLIYL ASNLESGVPARFSGSGSRTDFTLTIDPVQAEDAATYYCQQNAEDSRTFGGGTKL EIKGGGGS*DIQMTQSPSSLSASVGDRVTITCRASQDVNTAVAWYQQKPGKAPKL LIYSASFLYSGVPSRFSGSRSGTDFTLTISSLQPEDFATYYCQQHYTTPPTFGC GTKVEIK* | anti-IL13-VL- G4S-anti-Her2- (Trastuzumab- Q100C)-VL (SEQ ID NO: 6) |
| | EVQLKESGPGLVAPGGSLSITCTVSGFSLTDSSINWVRQPPGKGLEWLGMIWGD GRIDYADALKSRLSISKDSSKSQVFLEMTSLRTDDTATYYCARDGYFPYAMDFW GQGTSVTVSSGGGGS*EVQLVESGGGLVQPGGSLRLSCAASGFNIKDTYIHWVRQ APGKCLEWVARIYPTNGYTRYADSVKGRFTISADTSKNTAYLQMNSLRAEDTAV YYCSRWGGDGFYAMDYWGQGTLVTVSS*DKTHTCPPCPAPELLGGPSVFLFPPKP KDTLMISRTPEVTCVVVDVSHEDPEVKFNWYVDGVEVHNAKTKPREEQYNSTYR VVSVLTVLHQDWLNGKEYKCKVSNKALPAPIEKTISKAKGQPREPQVYTLPPSR DELTKNQVSLTCLVKGFYPSDIAVEWESNGQPENNYKTTPPVLDSDGSFFLYSK LTVDKSRWQQGNVFSCSVMHEALHNHYTQKSLSLSPG | anti-IL13-VH- G4S-anti-Her2- (Trastuzumab- G44C)-VH-Fc- huIgG1 (SEQ ID NO: 7) |
| 2 | DIVLTQSPASLAVSLGQRATISCRASESVDSYGQSYMHWYQQKAGQPPKLLIYL ASNLESGVPARFSGSGSRTDFTLTIDPVQAEDAATYYCQQNAEDSRTFGGGTKL EIKGGGGSGGGGS*DIQMTQSPSSLSASVGDRVTITCRASQDVNTAVAWYQQKPG KAPKWYSASFLYSGVPSRFSGSRSGTDFTLTISSLQPEDFATYYCQQHYTTPPT FGCGTKVEIK* | anti-IL13-VL- (G4S)2-anti-Her2- (Trastuzumab- Q100C)-VL (SEQ ID NO: 8) |
| | EVQLKESGPGLVAPGGSLSITCTVSGFSLTDSSINWVRQPPGKGLEWLGMIWGD GRIDYADALKSRLSISKDSSKSQVFLEMTSLRTDDTATYYCARDGYFPYAMDFW GQGTSVTVSSGGGGSGGGGS*EVQLVESGGGLVQPGGSLRLSCAASGFNIKDTYI HWVRQAPGKCLEWVARIYPTNGYTRYADSVKGRFTISADTSKNTAYLQMNSLRA EDTAVYYCSRWGGDGFYAMDYWGQGTLVTVSS*DKTHTCPPCPAPELLGGPSVFL FPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVY TLPPSRDELTKNQVSLTCLVKGFYPSDIAVEWESNGQPENNYKTTPPVLDSDGS FFLYSKLTVDKSRWQQGNVFSCSVMHEALHNHYTQKSLSLSPG | anti-IL13-VH- (G4S)2-anti- Her2- (Trastuzumab- G44C)-VH-Fc- huIgG1 (SEQ ID NO: 9) |

TABLE 2-continued

Sequences of selected binding proteins

| ID | Sequence | Annotation: |
|----|----------|-------------|
| 3 | DIVLTQSPASLAVSLGQRATISCRASESVDSYGQSYMHWYQQKAGQPPKLLIYL ASNLESGVPARFSGSGSRTDFTLTIDPVQAEDAATYYCQQNAEDSRTFGGGTKL EIKRTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFNRG EC | anti-IL13-VL3-IGKC (SEQ ID NO: 10) |
| | EVQLKESGPGLVAPGGSLSITCTVSGFSLTDSSINWVRQPPGKGLEWLGMIWGD GRIDYADALKSRLSISKDSSKSQVFLEMTSLRTDDTATYYCARDGYFPYAMDFW GQGTSVTVSSASTKGPSVFPLAPSSKSTSGGTAALGCLVKDYFPEPVTVSWNSG ALTSGVHTFPAVLQSSGLYSLSSVVTVPSSSLGTQTYICNVNHKPSNTKVDKKV EPKSCDKTHTCPPCPAPELLGGPSVFLFPPKPKDTLMISRTPEVTCVVVDVSHE DPEVKFNWYVDGVEVHNAKTKPREEQYNSTYRVVSVLTVLHQDWLNGKEYKCKV SNKALPAPIEKTISKAKGQPREPQVYTLPPSRDELTKNQVSLTCLVKGFYPSDI AVEWESNGQPENNYKTTPPVLDSDGSFFLYSKLTVDKSRWQQGNVFSCSVMHEA LHNHYTQKSLSLSPG | anti-IL13-VH2-IGHG1 (SEQ ID NO: 11) |
| 4 | DIQMTQSPSSLSASVGDRVTITCRASQGIRNYLAWYQQKPGKAPKLLIYAASTL QSGVPSRFSGSGSGTDFTLTISSLQPEDVATYYCQRYNRAPYTFGQGTKVEIKG GGGSDIQMTQSPSSLSASVGDRVTITCRASQDVNTAVAWYQQKPGKAPKWYSAS FLYSGVPSRFSGSRSGTDFTLTISSLQPEDFATYYCQQHYTTPPTFGCGTKVEI K | anti-TNFalpha-VL-G4S-anti-Her2-(Trastuzumab-Q100C)-VL (SEQ ID NO: 12) |
| | EVQLVESGGGLVQPGRSLRLSCAASGFTFDDYAMHWVRQAPGKGLEWVSAITWN SGHIDYADSVEGRFTISRDNAKNSLYLQMNSLRAEDTAVYYCAKVSYLSTASSL DYWGQGTLVTVSSGGGGSEVQLVESGGGLVQPGGSLRLSCAASGFNIKDTYIHW VRQAPGKCLEWVARIYPTNGYTRYADSVKGRFTISADTSKNTAYLQMNSLRAED TAVYYCSRWGGDGFYAMDYWGQGTLVTVSSDKTHTCPPCPAPELLGGPSVFLFP PKPKDTLMISRTPEVTCVVVDVSHEDPEVKFNWYVDGVEVHNAKTKPREEQYNS TYRVVSVLTVLHQDWLNGKEYKCKVSNKALPAPIEKTISKAKGQPREPQVYTLP PSRDELTKNQVSLTCLVKGFYPSDIAVEWESNGQPENNYKTTPPVLDSDGSFFL YSKLTVDKSRWQQGNVFSCSVMHEALHNHYTQKSLSLSPG | anti-TNFalpha-VL-G4S-anti-Her2-(Trastuzumab-G44C)-VH-Fc-huIgG1 (SEQ ID NO: 13) |
| 5 | DIQMTQSPSSLSASVGDRVTITCRASQGIRNYLAWYQQKPGKAPKLLIYAASTL QSGVPSRFSGSGSGTDFTLTISSLQPEDVATYYCQRYNRAPYTFGQGTKVEIKG GGGSGGGGSDIQMTQSPSSLSASVGDRVTITCRASQDVNTAVAWYQQKPGKAPK WYSASFLYSGVPSRFSGSRSGTDFTLTISSLQPEDFATYYCQQHYTTPPTFGCG TKVEIK | anti-TNF-alpha-VL-(G4S)2-anti-Her2-(Trastuzumab-Q100C)-VL (SEQ ID NO: 14) |
| | EVQLVESGGGLVQPGRSLRLSCAASGFTFDDYAMHWVRQAPGKGLEWVSAITWN SGHIDYADSVEGRFTISRDNAKNSLYLQMNSLRAEDTAVYYCAKVSYLSTASSL DYWGQGTLVTVSSGGGGSGGGGSEVQLVESGGGLVQPGGSLRLSCAASGFNIKD TYIHWVRQAPGKCLEWVARIYPTNGYTRYADSVKGRFTISADTSKNTAYLQMNS LRAEDTAVYYCSRWGGDGFYAMDYWGQGTLVTVSSDKTHTCPPCPAPELLGGPS VFLFPPKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQPREPQ VYTLPPSRDELTKNQVSLTCLVKGFYPSDIAVEWESNGQPENNYKTTPPVLDSD GSFFLYSKLTVDKSRWQQGNVFSCSVMHEALHNHYTQKSLSLSPG | anti-TNF-alpha-VL-(G4S)2-anti-Her2-(Trastuzumab-G44C)-VH-Fc-huIgG1 (SEQ ID NO: 15) |
| 6 | DIQMTQSPSSLSASVGDRVTITCRASQGIRNYLAWYQQKPGKAPKLLIYAASTL QSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC | anti-TNFa-VL-huIGKC (SEQ ID NO: 16) |
| | EVQLVESGGGLVQPGRSLRLSCAASGFTFDDYAMHWVRQAPGKGLEWVSAITWN SGHIDYADSVEGRFTISRDNAKNSLYLQMNSLRAEDTAVYYCAKVSYLSTASSL DYWGQGTLVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVD KKVEPKSCDKTHTCPPCPAPELLGGPSVFLFPPKPKDTLMISRTPEVTCVVVDV SHEDPEVKFNWYVDGVEVHNAKTKPREEQYNSTYRVVSVLTVLHQDWLNGKEYK CKVSNKALPAPIEKTISKAKGQPREPQVYTLPPSRDELTKNQVSLTCLVKGFYP SDIAVEWESNGQPENNYKTTPPVLDSDGSFFLYSKLTVDKSRWQQGNVFSCSVM HEALHNHYTQKSLSLSPG | anti-TNFa-VH-huIgG1 (SEQ ID NO: 17) |

TABLE 2-continued

Sequences of selected binding proteins

| ID | Sequence | Annotation: |
|---|---|---|
| 7 | DIQMTQSPSSLSASVGDRVTITCRASQDISSYLNWYQQKPGKAPKLLIYYTSRL HSGVPSRFSGSGSGTDFTFTISSLQPEDIATYYCQQGNTLPYTFGQGTKVEIK<u>G GGGS</u>DIQMTQSPSSLSASVGDRVTITCRASQDVNTAVAWYQQKPGKAPKLLIYS ASFLYSGVPSRFSGSRSGTDFTLTISSLQPEDFATYYCQQHYTTPPTFGCGTKV EIK | anti-IL6R-VL- G4S-anti-Her2- (Trastuzumab- Q100C)-VL (SEQ ID NO: 18) |
| | QVQLQESGPGLVRPSQTLSLTCTVSGYSITSDHAWSWVRQPPGRGLEWIGYISY SGITTYNPSLKSRVTMLRDTSKNQFSLRLSSVTAADTAVYYCARSLARTTAMDY WGQGSLVTVSS<u>GGGGS</u>EVQLVESGGGLVQPGGSLRLSCAASGFNIKDTYIHWVR QAPGKCLEWVARIYPTNGYTRYADSVKGRFTISADTSKNTAYLQMNSLRAEDTA VYYCSRWGGDGFYAMDYWGQGTLVTVSS<i>DKTHTCPPCPAPELLGGPSVFLFPPK PKDTLMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYTLPPS RDELTKNQVSLTCLVKGFYPSDIAVEWESNGQPENNYKTTPPVLDSDGSFFLYS KLTVDKSRWQQGNVFSCSVMHEALHNHYTQKSLSLSPG</i> | anti-IL6R-VH- G4S-anti-Her2- (Trastuzumab- G44C)-VH-Fc- huIgG1 (SEQ ID NO: 19) |
| 8 | DIQMTQSPSSLSASVGDRVTITCRASQDISSYLNWYQQKPGKAPKLLIYYTSRL HSGVPSRFSGSGSGTDFTFTISSLQPEDIATYYCQQGNTLPYTFGQGTKVEIK<u>G GGGSGGGGS</u>DIQMTQSPSSLSASVGDRVTITCRASQDVNTAVAWYQQKPGKAPK WYSASFLYSGVPSRFSGSRSGTDFTLTISSLQPEDFATYYCQQHYTTPPTFGCG TKVEIK | anti-IL6R-VL- (G4S)2-anit-Hers- (Trastuzumab- Q100C)-VL (SEQ ID NO: 20) |
| | QVQLQESGPGLVRPSQTLSLTCTVSGYSITSDHAWSWVRQPPGRGLEWIGYISY SGITTYNPSLKSRVTMLRDTSKNQFSLRLSSVTAADTAVYYCARSLARTTAMDY WGQGSLVTVSS<u>GGGGSGGGGS</u>EVQLVESGGGLVQPGGSLRLSCAASGFNIKDTY IHWVRQAPGKCLEWVARIYPTNGYTRYADSVKGRFTISADTSKNTAYLQMNSLR AEDTAVYYCSRWGGDGFYAMDYWGQGTLVTVSS<i>DKTHTCPPCPAPELLGGPSVF LFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVY TLPPSRDELTKNQVSLTCLVKGFYPSDIAVEWESNGQPENNYKTTPPVLDSDGS FFLYSKLTVDKSRWQQGNVFSCSVMHEALHNHYTQKSLSLSPG</i> | anti-IL6R-VL- (G4S)2-anit- Her2- (Trastuzumab- G44C)-VH-Fc- huIgG1 (SEQ ID NO: 21) |
| 9 | DIQMTQSPSSLSASVGDRVTITCRASQDISSYLNWYQQKPGKAPKLLIYYTSRL HSGVPSRFSGSGSGTDFTFTISSLQPEDIATYYCQQGNTLPYTFGQGTKVEIK<i>R TVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC</i> | anti-IL6R-VL- huIGKC (SEQ ID NO: 22) |
| | QVQLQESGPGLVRPSQTLSLTCTVSGYSITSDHAWSWVRQPPGRGLEWIGYISY SGITTYNPSLKSRVTMLRDTSKNQFSLRLSSVTAADTAVYYCARSLARTTAMDY WGQGSLVTVSS<i>ASTKGPSVFPLAPSSKSTSGGTAALGCLVKDYFPEPVTVSWNS GALTSGVHTFPAVLQSSGLYSLSSVVTVPSSSLGTQTYICNVNHKPSNTKVDKK VEPKSCDKTHTCPPCPAPELLGGPSVFLFPPKPKDTLMISRTPEVTCVVVDVSH EDPEVKFNWYVDGVEVHNAKTKPREEQYNSTYRVVSVLTVLHQDWLNGKEYKCK VSNKALPAPIEKTISKAKGQPREPQVYTLPPSRDELTKNQVSLTCLVKGFYPSD IAVEWESNGQPENNYKTTPPVLDSDGSFFLYSKLTVDKSRWQQGNVFSCSVMHE ALHNHYTQKSLSLSPG</i> | anti-IL6R-VH- huIgG1 (SEQ ID NO: 23) |
| 10 | EIVLTQSPGTLSLSPGERATLSCRASQSVGSSYLAWYQQKPGQAPRLLIYGAFS RATGIPDRFSGSGSGTDFTLTISRLEPEDFAVYYCQQYGSSPWTFGQGTKVEIK <u>GGGGS</u>DIQMTQSPSSLSASVGDRVTITCRASQDVNTAVAWYQQKPGKAPKLLIY SASFLYSGVPSRFSGSRSGTDFTLTISSLQPEDFATYYCQQHYTTPPTFGCGTK VEIK | anti-CTLA4-VL- G4S-anti-Her2- (Trastuzumab- Q100C)-VL (SEQ ID NO: 24) |
| | QVQLVESGGGVVQPGRSLRLSCAASGFTFSSYTMHWVRQAPGKGLEWVTFISYD GNNKYYADSVKGRFTISRDNSKNTLYLQMNSLRAEDTAIYYCARTGWLGPFDYW GQGTLVTVSS<u>GGGGS</u>EVQLVESGGGLVQPGGSLRLSCAASGFNIKDTYIHWVRQ APGKCLEWVARIYPTNGYTRYADSVKGRFTISADTSKNTAYLQMNSLRAEDTAV YYCSRWGGDGFYAMDYWGQGTLVTVSS<i>DKTHTCPPCPAPELLGGPSVFLFPPKP KDTLMISRTPEVTCVVVDVSHEDPEVKFNWYVDGVEVHNAKTKPREEQYNSTYR VVSVLTVLHQDWLNGKEYKCKVSNKALPAPIEKTISKAKGQPREPQVYTLPPSR DELTKNQVSLTCLVKGFYPSDIAVEWESNGQPENNYKTTPPVLDSDGSFFLYSK LTVDKSRWQQGNVFSCSVMHEALHNHYTQKSLSLSPG</i> | anti-CTLA4-VH- G4S-anti-Her2- (Trastuzumab- G44C)-VH-Fc- huIgG1 (SEQ ID NO: 25) |

TABLE 2-continued

Sequences of selected binding proteins

| ID | Sequence | Annotation: |
|---|---|---|
| 11 | EIVLTQSPGTLSLSPGERATLSCRASQSVGSSYLAWYQQKPGQAPRLLIYGAFS<br>RATGIPDRFSGSGSGTDFTLTISRLEPEDFAVYYCQQYGSSPWTFGQGTKVEIK<br><u>GGGGSGGGGS</u>DIQMTQSPSSLSASVGDRVTITCRASQDVNTAVAWYQQKPGKAP<br>KWYSASFLYSGVPSRFSGSRSGTDFTLTISSLQPEDFATYYCQQHYTTPPTFGC<br>G | anti-CTLA4-VL-<br>(G4S)2-anti-Her2-<br>(Trastuzumab-<br>Q100C)-VL<br>(SEQ ID NO: 26) |
|    | QVQLVESGGGVVQPGRSLRLSCAASGFTFSSYTMHWVRQAPGKGLEWVTFISYD<br>GNNKYYADSVKGRFTISRDNSKNTLYLQMNSLRAEDTAIYYCARTGWLGPFDYW<br>GQGTLVTVSS<u>GGGGSGGGGS</u>EVQLVESGGGLVQPGGSLRLSCAASGFNIKDTYI<br>HWVRQAPGKCLEWVARIYPTNGYTRYADSVKGRFTISADTSKNTAYLQMNSLRA<br>EDTAVYYCSRWGGDGFYAMDYWGQGTLVTVSS*DKTHTCPPCPAPELLGGPSVFL*<br>*FPPKPKDTLMISRTPEVTCVVVDVSHEDPEVKFNWYVDGVEVHNAKTKPREEQY*<br>*NSTYRVVSVLTVLHQDWLNGKEYKCKVSNKALPAPIEKTISKAKGQPREPQVYT*<br>*LPPSRDELTKNQVSLTCLVKGFYPSDIAVEWESNGQPENNYKTTPPVLDSDGSF*<br>*FLYSKLTVDKSRWQQGNVFSCSVMHEALHNHYTQKSLSLSPG* | anti-CTLA4-VL-<br>(G4S)2-anti-<br>Her2-<br>(Trastuzumab-<br>G44C)-VH-Fc-<br>huIgG1<br>(SEQ ID NO: 27) |
| 12 | EIVLTQSPGTLSLSPGERATLSCRASQSVGSSYLAWYQQKPGQAPRLLIYGAFS<br>RATGIPDRFSGSGSGTDFTLTISRLEPEDFAVYYCQQYGSSPWTFGQGTKVEIK<br>RTVAAPSVFIFPPSDEQLKSGTASVVCLLNNFYPREAKVQWKVDNALQSGNSQE<br>SVTEQDSKDSTYSLSSTLTLSKADYEKHKVYACEVTHQGLSSPVTKSFNRGEC | anti-CTLA4-VL-<br>huIGKC<br>(SEQ ID NO: 28) |
|    | QVQLVESGGGVVQPGRSLRLSCAASGFTFSSYTMHWVRQAPGKGLEWVTFISYD<br>GNNKYYADSVKGRFTISRDNSKNTLYLQMNSLRAEDTAIYYCARTGWLGPFDYW<br>GQGTLVTVSSASTKGPSVFPLAPSSKSTSGGTAALGCLVKDYFPEPVTVSWNSG<br>ALTSGVHTFPAVLQSSGLYSLSSVVTVPSSSLGTQTYICNVNHKPSNTKVDKKV<br>EPKSCDKTHTCPPCPAPELLGGPSVFLFPPKPKDTLMISRTPEVTCVVVDVSHE<br>DPEVKFNWYVDGVEVHNAKTKPREEQYNSTYRVVSVLTVLHQDWLNGKEYKCKV<br>SNKALPAPIEKTISKAKGQPREPQVYTLPPSRDELTKNQVSLTCLVKGFYPSDI<br>AVEWESNGQPENNYKTTPPVLDSDGSFFLYSKLTVDKSRWQQGNVFSCSVMHEA<br>LHNHYTQKSLSLSPG | anti-CTLA4-VH-<br>huIgG1<br>(SEQ ID NO: 29) |
| 13 | EIVLTQSPATLSLSPGERATLSCRASQSVSSYLAWYQQKPGQAPRLLIYDASNR<br>ATGIPARFSGSGSGTDFTLTISSLEPEDFAVYYCQQSNWPRTFGQGTKVEIK<u>G</u><br><u>GGGS</u>DIQMTQSPSSLSASVGDRVTITCRASQDVNTAVAWYQQKPGKAPKLLIYS<br>ASFLYSGVPSRFSGSRSGTDFTLTISSLQPEDFATYYCQQHYTTPPTFGCGTKV<br>EIK | anti-PD1-VL-<br>G4S-anti-Her2-<br>(Trastuzumab-<br>Q100C)-VL-<br>(SEQ ID NO: 30) |
|    | QVQLVESGGGVVQPGRSLRLDCKASGITFSNSGMHWVRQAPGKGLEWVAVIWYD<br>GSKRYYADSVKGRFTISRDNSKNTLFLQMNSLRAEDTAVYYCATNDDYWGQGTL<br>VTVSS<u>GGGGS</u>EVQLVESGGGLVQPGGSLRLSCAASGFNIKDTYIHWVRQAPKC<br>LEWVARIYPTNGYTRYADSVKGRFTISADTSKNTAYLQMNSLRAEDTAVYYCSR<br>WGGDGFYAMDYWGQGTLVTVSS*DKTHTCPPCPAPELLGGPSVFLFPPKPKDTLM*<br>*ISRTPEVTCVVVDVSHEDPEVKFNWYVDGVEVHNAKTKPREEQYNSTYRVVSVL*<br>*TVLHQDWLNGKEYKCKVSNKALPAPIEKTISKAKGQPREPQVYTLPPSRDELTK*<br>*NQVSLTCLVKGFYPSDIAVEWESNGQPENNYKTTPPVLDSDGSFFLYSKLTVDK*<br>*SRWQQGNVFSCSVMHEALHNHYTQKSLSLSPG* | anti-PD1-VH-<br>(G4S)-anti-Her2-<br>(Trastuzumab-<br>G44C)-VH-Fc-<br>huIgG1<br>(SEQ ID NO: 31) |
| 14 | EIVLTQSPATLSLSPGERATLSCRASQSVSSYLAWYQQKPGQAPRLLIYDASNR<br>ATGIPARFSGSGSGTDFTLTISSLEPEDFAVYYCQQSNWPRTFGQGTKVEIK<u>G</u><br><u>GGGSGGGGS</u>DIQMTQSPSSLSASVGDRVTITCRASQDVNTAVAWYQQKPGKAPK<br>WYSASFLYSGVPSRFSGSRSGTDFTLTISSLQPEDFATYYCQQHYTTPPTFGCG<br>TKVEIK | anti-PD1-VL-<br>(G4S)2-anti-Her2-<br>(Trastuzumab-<br>Q100C)-VL<br>(SEQ ID NO: 32) |
|    | QVQLVESGGGVVQPGRSLRLDCKASGITFSNSGMHWVRQAPGKGLEWVAVIWYD<br>GSKRYYADSVKGRFTISRDNSKNTLFLQMNSLRAEDTAVYYCATNDDYWGQGTL<br>VTVSS<u>GGGGSGGGGS</u>EVQLVESGGGLVQPGGSLRLSCAASGFNIKDTYIHWVRQ<br>APGKCLEWVARIYPTNGYTRYADSVKGRFTISADTSKNTAYLQMNSLRAEDTAV<br>YYCSRWGGDGFYAMDYWGQGTLVTVSSDKTHTCPPCPAPELLGGPSVFLFPPKP<br>KDTLMISRTPEVTCVVVDVSHEDPEVKFNWYVDGVEVHNAKTKPREEQYNSTYR<br>VVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSK<br>LTVDKSRWQQGNVFSCSVMHEALHNHYTQKSLSLSPG | anti-PD1-VH-<br>(G4S)2-anti-<br>Her2-<br>(Trastuzumab-<br>G44C)-VH-Fc-<br>huIgG1<br>(SEQ ID NO: 33) |
| 15 | EIVLTQSPATLSLSPGERATLSCRASQSVSSYLAWYQQKPGQAPRLLIYDASNR<br>ATGIPARFSGSGSGTDFTLTISSLEPEDFAVYYCQQSNWPRTFGQGTKVEIKR<br>TVAAPSVFIFPPSDEQLKSGTASVVCLLNNFYPREAKVQWKVDNALQSGNSQES<br>VTEQDSKDSTYSLSSTLTLSKADYEKHKVYACEVTHQGLSSPVTKSFNRGEC | anti-huPD-1-<br>VL-huIGKC<br>(SEQ ID NO: 34) |
|    | QVQLVESGGGVVQPGRSLRLDCKASGITFSNSGMHWVRQAPGKGLEWVAVIWYD<br>GSKRYYADSVKGRFTISRDNSKNTLFLQMNSLRAEDTAVYYCATNDDYWGQGTL<br>VTVSSASTKGPSVFPLAPSSKSTSGGTAALGCLVKDYFPEPVTVSWNSGALTSG<br>VHTFPAVLQSSGLYSLSSVVTVPSSSLGTQTYICNVNHKPSNTKVDKKVEPKSC<br>DKTHTCPPCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVEWE<br>SNGQPENNYKTTPPVLDSDGSFFLYSKLTVDKSRWQQGNVFSCSVMHEALHNHY<br>TQKSLSLSPG | anti-huPD-1-<br>VH-huIGKC<br>(SEQ ID NO: 35) |

TABLE 2-continued

Sequences of selected binding proteins

| ID | Sequence | Annotation: |
|----|----------|-------------|
| 16 | DIQMTQSPASLSVSVGDTITLTCHASQNIDVWLSWFQQKPGNIPKLLIYKASNL<br>HTGVPSRFSGSGSGTGFTLTISSLQPEDIATYYCQQAHSYPFTFGGGTKLEIK<u>G</u><br><u>GGGS</u>DIQMTQSPSSLSASVGDRVTITCRASQDVNTAVAWYQQKPGKAPKLLIYS<br>ASFLYSGVPSRFSGSRSGTDFTLTISSLQPEDFATYYCQQHYTTPPTFGCGTKV<br>EIK | anti-IL4-VL-<br>G4S-anti-Her2-<br>(Trastuzumab-<br>Q100C)-VL<br>(SEQ ID NO: 36) |
|    | QVQLQQSGPELVKPGASVKISCKASGYSFTSYWIHWIKQRPGQGLEWIGMIDPS<br>DGETRLNQRFQGRATLTVDESTSTAYMQLRSPTSEDSAVYYCTRLKEYGNYDSF<br>YFDVWGAGTLVTVSSGGGGS<i>EVQLVESGGGLVQPGGSLRLSCAASGFNIKDTYI<br>HWVRQAPGKCLEWVARIYPTNGYTRYADSVKGRFTISADTSKNTAYLQMNSLRA<br>EDTAVYYCSRWGGDGFYAMDYWGQGTLVTVSS</i><u>DKTHTCPPCPAPELLGGPSVFL<br>FPPKPKDTLMISRTPEVTCVVVDVSHEDPEVKFNWYVDGVEVHNAKTKPREEQY<br>NSTYRVVSVLTVLHQDWLNGKEYKCKVSNKALPAPIEKTISKAKGQPREPQVYT<br>LPPSRDELTKNQVSLTCLVKGFYPSDIAVEWESNGQPENNYKTTPPVLDSDGSF<br>FLYSKLTVDKSRWQQGNVFSCSVMHEALHNHYTQKSLSLSPG</u> | anti-IL4-VH-<br>G4S-anti-Her2-<br>(Trastuzumab-<br>G44C)-VH-Fc-<br>huIgG1<br>(SEQ ID NO: 37) |
| 17 | DIQMTQSPASLSVSVGDTITLTCHASQNIDVWLSWFQQKPGNIPKLLIYKASNL<br>HTGVPSRFSGSGSGTGFTLTISSLQPEDIATYYCQQAHSYPFTFGGGTKLEIK<u>G<br>GGGSGGGGS</u>DIQMTQSPSSLSASVGDRVTITCRASQDVNTAVAWYQQKPGKAPK<br>WYSASFLYSGVPSRFSGSRSGTDFTLTISSLQPEDFATYYCQQHYTTPPTFGCG<br>TKVEIK | anti-IL4-VL-<br>(G4S)2-anti-Her2-<br>(Trastuzumab-<br>Q100C)-VL<br>(SEQ ID NO: 38) |
|    | QVQLQQSGPELVKPGASVKISCKASGYSFTSYWIHWIKQRPGQGLEWIGMIDPS<br>DGETRLNQRFQGRATLTVDESTSTAYMQLRSPTSEDSAVYYCTRLKEYGNYDSF<br>YFDVWGAGTLVTVSSGGGGSGGGGS<i>EVQLVESGGGLVQPGGSLRLSCAASGFNI<br>KDTYIHWVRQAPGKCLEWVARIYPTNGYTRYADSVKGRFTISADTSKNTAYLQM<br>NSLRAEDTAVYYCSRWGGDGFYAMDYWGQGTLVTVSS</i><u>DKTHTCPPCPAPELLGG<br>PSVFLFPPKPKDTLMISRTPEVTCVVVDVSHEDPEVKFNWYVDGVEVHNAKTKP<br>REEQYNSTYRVVSVLTVLHQDWLNGKEYKCKVSNKALPAPIEKTISKAKGQPRE<br>PQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPG</u> | anti-IL4-VH-<br>(G4S)2-anti-<br>Her2-<br>(Trastuzumab-<br>G44C)-VH-Fc-<br>huIgG1<br>(SEQ ID NO: 39) |
| 18 | DIQMTQSPASLSVSVGDTITLTCHASQNIDVWLSWFQQKPGNIPKLLIYKASNL<br>HTGVPSRFSGSGSGTGFTLTISSLQPEDIATYYCQQAHSYPFTFGGGTKLEIK<i>R<br>TVAAPSVFIFPPSDEQLKSGTASVVCLLNNFYPREAKVQWKVDNALQSGNSQE<br>SVTEQDSKDSTYSLSSTLTLSKADYEKHKVYACEVTHQGLSSPVTKSFNRGEC</i> | anti-IL4-VL1-<br>IGKC<br>(SEQ ID NO: 40) |
|    | QVQLQQSGPELVKPGASVKISCKASGYSFTSYWIHWIKQRPGQGLEWIGMIDPS<br>DGETRLNQRFQGRATLTVDESTSTAYMQLRSPTSEDSAVYYCTRLKEYGNYDSF<br>YFDVWGAGTLVTVSS<i>ASTKGPSVFPLAPSSKSTSGGTAALGCLVKDYFPEPVTV<br>SWNSGALTSGVHTFPAVLQSSGLYSLSSVVTVPSSSLGTQTYICNVNHKPSNTK<br>VDKKVEPKSCDKTHTCPPCPAPELLGGPSVFLFPPKPKDTLMISRTPEVTCVVV<br>DVSHEDPEVKFNWYVDGVEVHNAKTKPREEQYNSTYRVVSVLTVLHQDWLNGKE<br>YKCKVSNKALPAPIEKTISKAKGQPREPQVYTLPPSRDELTKNQVSLTCLVKGF<br>YPSDIAVEWESNGQPENNYKTTPPVLDSDGSFFLYSKLTVDKSRWQQGNVFSCS<br>VMHEALHNHYTQKSLSLSPG</i> | anti-IL4-VH1-<br>IgG1<br>(SEQ ID NO: 41) |
| 19 | EIVLTQSPATLSLSPGERATLSCRASQSVSSYLAWYQQKPGQAPRLLIYDASNR<br>ATGIPARFSGSGSGTDFTLTISSLEPEDFAVYYCQQSSNWPRTFGQGTKVEIK<u>G<br>GGGSGGGGS</u>DIQMTQSPSSLSASVGDRVTITCRASQDVNTAVAWYQQKPGKAPK<br>WYSASFLYSGVPSRFSGSRSGTDFTLTISSLQPEDFATYYCQQHYTTPPTFGCG<br>TKVEIK | anti-PD1-VL-<br>(G4S)2-anti-Her2-<br>(Trastuzumab-<br>Q100C)-VL<br>(SEQ ID NO: 42) |
|    | QVQLVESGGGVVQPGRSLRLDCKASGITFSNSGMHWVRQAPGKGLEWVAVIWYD<br>GSKRYYADSVKGRFTISRDNSKNTLFLQMNSLRAEDTAVYYCATNDDYWGQGTL<br>VTVSS<u>GGGGSGGGGS</u><i>EVQLVESGGGLVQPGGSLRLSCAASGFNIKDTYIHWVRQ<br>APGKCLEWVARIYPTNGYTEYADSVKGRFTISADTSKNTAYLQMNSLRAEDTAV<br>YYCSRWGGDGFYAMDYWGQGTLVTVSS</i><u>DKTHTCPPCPAPELLGGPSVFLFPPKP<br>KDTLMISRTPEVTCVVVDVSHEDPEVKFNWYVDGVEVHNAKTKPREEQYNSTYR<br>VVSVLTVLHQDWLNGKEYKCKVSNKALPAPIEKTISKAKGQPREPQVYTLPPSR<br>DELTKNQVSLTCLVKGFYPSDIAVEWESNGQPENNYKTTPPVLDSDGSFFLYSK<br>LTVDKSRWQQGNVFSCSVMHEALHNHYTQKSLSLSPG</u> | anti-PD1-VL-<br>(G4S)2-anti-<br>Her2-<br>(Trastuzumab-<br>G44C)-Var2)-VH-<br>Fc-huIgG1<br>(SEQ ID NO: 43) |
| 20 | EIVLTQSPGTLSLSPGERATLSCRASQSVGSSYLAWYQQKPGQAPRLLIYGAFS<br>RATGIPDRFSGSGSGTDFTLTISRLEPEDFAVYYCQQYGSSPWTFGQGTKVEIK<br><u>GGGGSGGGGS</u>DIQMTQSPSSLSASVGDRVTITCRASQDVNTAVAWYQQKPGKAP<br>KWYSASFLYSGVPSRFSGSRSGTDFTLTISSLQPEDFATYYCQQHYTTPPTFGC<br>GTKVEIK | anti-CTLA4-VL-<br>(G4S)2-anti-Her2-<br>(Trastuzumab-<br>Q100C)-VL<br>(SEQ ID NO: 44) |
|    | QVQLVESGGGVVQPGRSLRLSCAASGFTFSSYTMHWVRQAPGKGLEWVTFISYD<br>GNNKYYADSVKGRFTISRDNSKNTLYLQMNSLRAEDTAIYYCARTGWLGPFDYW<br>GQGTLVTVSS<u>GGGGSGGGGS</u><i>EVQLVESGGGLVQPGGSLRLSCAASGFNIKDTYI<br>HWVRQAPGKCLEWVAEIYPTNGYTEYADSVKGRFTISADTSKNTAYLQMNSLRA</i> | anti-CTLA4-VH-<br>(G4S)2-anti-<br>Her2-<br>(Trastuzumab- |

TABLE 2-continued

Sequences of selected binding proteins

| ID | Sequence | Annotation: |
|---|---|---|
|  | EDTAVYYCSRWGGDGFYAMDYWGQGTLVTVSS*DKTHTCPPCPAPELLGGPSVFL FPPKPKDTLMISRTPEVTCVVVDVSHEDPEVKFNWYVDGVEVHNAKTKPREEQY NSTYRVVSVLTVLHQDWLNGKEYKCKVSNKALPAPIEKTISKAKGQPREPQVYT LPPSRDELTKNQVSLTCLVKGFYPSDIAVEWESNGQPENNYKTTPPVLDSDGSF FLYSKLTVDKSRWQQGNVFSCSVMHEALHNHYTQKSLSLSPG* | G44C-Var2)-VH-Fc-huIgG1 (SEQ ID NO: 45) |
| 21 | DIQMTQSPASLSVSVGDTITLTCHASQNIDVWLSWFQQKPGNIPKLLIYKASNL HTGVPSRFSGSGSGTGFTLTISSLQPEDIATYYCQQAHSYPFTFGGGTKLEIK*G GGGSGGGGS*DIQMTQSPSSLSASVGDRVTITCRASQDVNTAVAWYQQKPGKAPK WYSASFLYSGVPSRFSGSRSGTDFTLTISSLQPEDFATYYCQQHYTTPPTFGCG TKVEIK | anti-IL4-VL-(G4S)2-anti-Her2-(Trastuzumab-Q100C)-VL (SEQ ID NO: 46) |
|  | QVQLQQSGPELVKPGASVKISCKASGYSFTSYWIHWIKQRPGQGLEWIGMIDPS DGETRLNQRFQGRATLTVDESTSTAYMQLRSPTSEDSAVYYCTRLKEYGNYDSF YFDVWGAGTLVTVSS*GGGGSGGGGS*EVQLVESGGGLVQPGGSLRLSCAASGFNI KDTYIHWVRQAPGKCLEWVAEIYPTNGYTEYADSVKGRFTISADTSKNTAYLQM NSLRAEDTAVYYCSRWGGDGFYAMDYWGQGTLVTVSS*DKTHTCPPCPAPELLGG PSVFLFPPKPKDTLMISRTPEVTCVVVDVSHEDPEVKFNWYVDGVEVHNAKTKP REEQYNSTYRVVSVLTVLHQDWLNGKEYKCKVSNKALPAPIEKTISKAKGQPRE PQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPG* | anti-IL4-VH-(G4S)2-anti-Her2-(Trastuzumab-G44C-Var2)-VH-Fc-huIgG1 (SEQ ID NO: 47) |
| 22 | DIVLTQSPASLAVSLGQRATISCRASESVDSYGQSYMHWYQQKAGQPPKLLIYL ASNLESGVPARFSGSGSRTDFTLTIDPVQAEDAATYYCQQNAEDSRTFGGGTKL EIK*GGGGSGGGGS*DIQMTQSPSSLSASVGDRVTITCRASQDVNTAVAWYQQKPG KAPKWYSASFLYSGVPSRFSGSRSGTDFTLTISSLQPEDFATYYCQQHYTTPPT FGCGTKVEIK | anti-IL13-VL-(G4S)2-anti-Her2-(Trastuzumab-Q100C)-VL (SEQ ID NO: 46) |
|  | EVQLKESGPGLVAPGGSLSITCTVSGFSLTDSSINWVRQPPGKGLEWLGMIWGD GRIDYADALKSRLSISKDSSKSQVFLEMTSLRTDDTATYYCARDGYFPYAMDFW GQGTSVTVSS*GGGGSGGGGS*EVQLVESGGGLVQPGGSLRLSCAASGFNIKDTYI HWVRQAPGKCLEWVAEIYPTNGYTEYADSVKGRFTISADTSKNTAYLQMNSLRA EDTAVYYCSRWGGDGFYAMDYWGQGTLVTVSS*DKTHTHHHHHH* | anti-IL13-VH-(G4S)2-anti-Her2-(Trastuzumab-G44C-Var2)-VH-Fc-huIgG1 DKTHT-His6 (SEQ ID NO: 49) |
| 23 | DIVLTQSPASLAVSLGQRATISCRASESVDSYGQSYMHWYQQKAGQPPKLLIYL ASNLESGVPARFSGSGSRTDFTLTIDPVQAEDAATYYCQQNAEDSRTFGGGTKL EIK*GGGGSGGGGS*DIQMTQSPSSLSASVGDRVTITCRASQDVNTAVAWYQQKPG KAPKLLIYSASFLYSGVPSRFSGSRSGTDFTLTISSLQPEDFATYYCQQHYTTP PTFGCGTKVEIK | anti-IL13-VL-(G4S)2-anti-Her2-(Trastuzumab-Q100C)-VL (SEQ ID NO: 50) |
|  | EVQLKESGPGLVAPGGSLSITCTVSGFSLTDSSINWVRQPPGKGLEWLGMIWGD GRIDYADALKSRLSISKDSSKSQVFLEMTSLRTDDTATYYCARDGYFPYAMDFW GQGTSVTVSS*GGGGSGGGGS*EVQLVESGGGLVQPGGSLRLSCAASGFNIKDTAI HWVRQAPGKCLEWVAEIYPTNGYTEYADSVKGRFTISADTSKNTAYLQMNSLRA EDTAVYYCSRWGGDGFAAMDYWGQGTLVTVSS*DKTHTCPPCPAPELLGGPSVFL FPPKPKDTLMISRTPEVTCVVVDVSHEDPEVKFNWYVDGVEVHNAKTKPREEQY NSTYRVVSVLTVLHQDWLNGKEYKCKVSNKALPAPIEKTISKAKGQPREPQVYT LPPSRDELTKNQVSLTCLVKGFYPSDIAVEWESNGQPENNYKTTPPVLDSDGSF FLYSKLTVDKSRWQQGNVFSCSVMHEALHNHYTQKSLSLSPG* | anti-IL13-VH-(G4S)2-anti-Her2-(Trastuzumab-VH_Var1-G44C)-VH-Fc-huIgG1 (SEQ ID NO: 51) |
| 24 | DIQMTQSPASLSVSVGDTITLTCHASQNIDVWLSWFQQKPGNIPKLLIYKASNL HTGVPSRFSGSGSGTGFTLTISSLQPEDIATYYCQQAHSYPFTFGGGTKLEIK*G GGGSGGGGS*DIQMTQSPSSLSASVGDRVTITCRASQDVNTAVAWYQQKPGKAPK WYSASFLYSGVPSRFSGSRSGTDFTLTISSLQPEDFATYYCQQHYTTPPTFGCG TKVEIK | anti-IL4-VL-(G4S)2-anti-Her2-(Trastuzumab-Q100C)-VL (SEQ ID NO: 52) |
|  | QVQLQQSGPELVKPGASVKISCKASGYSFTSYWIHWIKQRPGQGLEWIGMIDPS DGETRLNQRFQGRATLTVDESTSTAYMQLRSPTSEDSAVYYCTRLKEYGNYDSF YFDVWGAGTLVTVSS*GGGGSGGGGS*EVQLVESGGGLVQPGGSLRLSCAASGFNI KDTYIHWVRQAPGKCLEWVAEIYPTNGYTEYADSVKGRFTISADTSKNTAYLQM NSLRAEDTAVYYCSRWGGDGFYAMDYWGQGTLVTVSS*DKTHTCPPCPAPELLGG PSVFLFPPKPKDTLMISRTPEVTCVVVDVSHEDPEVKFNWYVDGVEVHNAKTKP REEQYNSTYRVVSVLTVLHQDWLNGKEYKCKVSNKALPAPIEKTISKAKGQPRE PQVYTLPPC̲RDELTKNQVSLW̲CLVKGFYPSDIAVEWESNGQPENNYKTTPPVLD SDGSFFLYSKLTVDKSRWQQGNVFSCSVMHEALHNHYTQKSLSLSPG* | anti-IL4-VH-(G4S)2-anti-Her2-(Trastuzumab-G44C-Var2)-VH-Fc-huIgG1(knob) (SEQ ID NO: 53) |
|  | EIVLTQSPATLSLSPGERATLSCRASQSVSSYLAWYQQKPGQAPRLLIYDASNR ATGIPARFSGSGSGTDFTLTISSLEPEDFAVYYCQQSSNWPRTFGQGTKVEIKR *TVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC* | anti-PD1-huIGKC (SEQ ID NO: 54) |
|  | QVQLVESGGGVVQPGRSLRLDCKASGITFSNSGMHWVRQAPGKGLEWVAVIWYD GSKRYYADSVKGRFTISRONSKNTLFLQMNSLRAEDTAVYYCATNDDYWGQGTL VTVSS*ASTKGPSVFPLAPSSKSTSGGTAALGCLVKDYFPEPVTVSWNSGALTSG* | anti-PD1-VH-huIgG1(hole-RF) (SEQ ID NO: 55) |

TABLE 2-continued

Sequences of selected binding proteins

| ID | Sequence | Annotation: |
|---|---|---|
| | *VHTFPAVLQSSGLYSLSSVVTVPSSSLGTQTYICNVNHKPSNTKVDKKVEPKSC DKTHTCPPCPAPELLGGPSVFLFPPKPKDTLMISRTPEVTCVVVDVSHEDPEVK FNWYVDGVEVHNAKTKPREEQYNSTYRVVSVLTVLHQDWLNGKEYKCKVSNKAL PAPIEKTISKAKGQPREPQVCTLPPSRDELTKNQVSLSCAVKGFYPSDIAVEWE SNGQPENNYKTTPPVLDSDGSFFLVSKLTVDKSRWQQGNVFSCSVMHEALHNRF TQKSLSLSPG* | |
| 25 | DIVLTQSPASLAVSLGQRATISCRASESVDSYGQSYMHWYQQKAGQPPKLLIYL ASNLESGVPARFSGSGSRTDFTLTIDPVQAEDAATYYCQQNAEDSRTFGGGTKL EIK<u>GGGGSGGGGS</u>DIQMTQSPSSLSASVGDRVTITCRASQDVNTAVAWYQQKPG KAPKWYSASFLYSGVPSRFSGSRSGTDFTLTISSLQPEDFATYYCQQHYTTPPT FGCGTKVEIK | anti-IL13-VL-(G4S)2-anti-Her2-(Trastuzumab-Q100C)-VL (SEQ ID NO: 56) |
| | EVQLKESGPGLVAPGGSLSITCTVSGFSLTDSSINWVRQPPGKGLEWLGMIWGD GRIDYADALKSRLSISKDSSKSQVFLEMTSLRTDDTATYYCARDGYFPYAMDFW GQGTSVTVSS<u>GGGGSGGGGS</u>EVQLVESGGGLVQPGGSLRLSCAASGFNIKDTYI HWVRQAPGKCLEWVAEIYPTNGYTEYADSVKGRFTISADTSKNTAYLQMNSLRA EDTAVYYCSRWGGDGFYAMDYWGQGTLVTVSS*DKTHTCPPCPAPELLGGPSVFL FPPKPKDTLMISRTPEVTCVVVDVSHEDPEVKFNWYVDGVEVHNAKTKPREEQY NSTYRVVSVLTVLHQDWLNGKEYKCKVSNKALPAPIEKTISKAKGQPREPQVYT LPPCRDELTKNQVSLWCLVKGFYPSDIAVEWESNGQPENNYKTTPPVLDSDGSF FLYSKLTVDKSRWQQGNVFSCSVMHEALHNHYTQKSLSLSPG* | anti-IL13-VH-(G4S)2-anti-Her2-(Trastuzumab-G44C)-Var2)-VH-Fc-huIgG1(knob) (SEQ ID NO: 57) |
| | EIVLTQSPATLSLSPGERATLSCRASQSVSSYLAWYQQKPGQAPRLLIYDASNR ATGIPARFSGSGSGTDFTLTISSLEPEDFAVYYCQQSSNWPRTFGQGTKVEIKR *TVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC* | anti-PD1-VL-huIGKC (SEQ ID NO: 58) |
| | QVQLVESGGGVVQPGRSLRLDCKASGITFSNSGMHWVRQAPGKGLEWVAVIWYD GSKRYYADSVKGRFTISRDNSKNTLFLQMNSLRAEDTAVYYCATNDDYWGQGTL VTVSS*ASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKKVEPKSC DKTHTCPPCPAPELLGGPSVFLFPPKPKDTLMISRTPEVTCVVVDVSHEDPEVK FNWYVDGVEVHNAKTKPREEQYNSTYRVVSVLTVLHQDWLNGKEYKCKVSNKAL PAPIEKTISKAKGQPREPQVCTLPPSRDELTKNQVSLSCAVKGFYPSDIAVEWE SNGQPENNYKTTPPVLDSDGSFFLVSKLTVDKSRWQQGNVFSCSVMHEALHNRF TQKSLSLSPG* | anti-PD1-VH-huIgG1 (hole-RF) (SEQ ID NO: 59) |
| 26 | EIVLTQSPATLSLSPGERATLSCRASQSVSSYLAWYQQKPGQAPRLLIYDASNR ATGIPARFSGSGSGTDFTLTISSLEPEDFAVYYCQQSSNWPRTFGQGTKVEIK<u>G GGGSGGGGS</u>DIQMTQSPSSLSASVGDRVTITCRASQDVNTAVAWYQQKPGKAPK WYSASFLYSGVPSRFSGSRSGTDFTLTISSLQPEDFATYYCQQHYTTPPTFGCG TKVEIK | anti-PD1-VL-(G4S)2-anti-Her2-(Trastuzumab-Q100C)-VL (SEQ ID NO: 60) |
| | QVQLVESGGGVVQPGRSLRLDCKASGITFSNSGMHWVRQAPGKGLEWVAVIWYD GSKRYYADSVKGRFTISRDNSKNTLFLQMNSLRAEDTAVYYCATNDDYWGQGTL VTVSS<u>GGGGSGGGGS</u>EVQLVESGGGLVQPGGSLRLSCAASGFNIKDTYIHWVRQ APGKCLEWVAEIYPTNGYTEYADSVKGRFTISADTSKNTAYLQMNSLRAEDTAV YYCSRWGGDGFYAMDYWGQGTLVTVSS*DKTHTCPPCPAPELLGGPSVFLFPPKP KDTLMISRTPEVTCVVVDVSHEDPEVKFNWYVDGVEVHNAKTKPREEQYNSTYR VVSVLTVLHQDWLNGKEYKCKVSNKALPAPIEKTISKAKGQPREPQVYTLPPCR DELTKNQVSLWCLVKGFYPSDIAVEWESNGQPENNYKTTPPVLDSDGSFFLYSK LTVDKSRWQQGNVFSCSVMHEALHNHYTQKSLSLSPG* | anti-PD1-VH-(G4S)2-anti-Her2-(Trastuzumab-G44C)-Var2)-VH-Fc-huIgG1(knob) (SEQ ID NO: 61) |
| | DIVLTQSPASLAVSLGQRATISCRASESVDSYGQSYMHWYQQKAGQPPKLLIYL ASNLESGVPARFSGSGSRTDFTLTIDPVQAEDAATYYCQQNAEDSRTFGGGTKL EIK*RTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFNRG EC* | anti-IL13-VL-huIGKC (SEQ ID NO: 62) |
| | EVQLKESGPGLVAPGGSLSITCTVSGFSLTDSSINWVRQPPGKGLEWLGMIWGD GRIDYADALKSRLSISKDSSKSQVFLEMTSLRTDDTATYYCARDGYFPYAMDFW GQGTSVTVSS*ASTKGPSVFPLAPSSKSTSGGTAALGCLVKDYFPEPVTVSWNSG ALTSGVHTFPAVLQSSGLYSLSSVVTVPSSSLGTQTYICNVNHKPSNTKVDKKV EPKSCDKTHTCPPCPAPELLGGPSVFLFPPKPKDTLMISRTPEVTCVVVDVSHE DPEVKFNWYVDGVEVHNAKTKPREEQYNSTYRVVSVLTVLHQDWLNGKEYKCKV SNKALPAPIEKTISKAKGQPREPQVCTLPPSRDELTKNQVSLSCAVKGFYPSDI AVEWESNGQPENNYKTTPPVLDSDGSFFLVSKLTVDKSRWQQGNVFSCSVMHEA LHNRFTQKSLSLSPG* | anti-IL13)-VH-huIgG1 (hole-RF) (SEQ ID NO: 63) |
| 27 | EIVLTQSPGTLSLSPGERATLSCRASQSVGSSYLAWYQQKPGQAPRLLIYGAFS RATGIPDRFSGSGSGTDFTLTISRLEPEDFAVYYCQQYGSSPWTFGQGTKVEIK <u>GGGGSGGGGS</u>DIQMTQSPSSLSASVGDRVTITCRASQDVNTAVAWYQQKPGKAP KWYSASFLYSGVPSRFSGSRSGTDFTLTISSLQPEDFATYYCQQHYTTPPTFGC GTKVEIK | anti-CTLA4-VL-(G4S)2-anti-Her2-(Trastuzumab-Q100C)-VL (SEQ ID NO: 64) |

TABLE 2-continued

Sequences of selected binding proteins

| ID | Sequence | Annotation: |
|---|---|---|
| | QVQLVESGGGVVQPGRSLRLSCAASGFTFSSYTMHWVRQAPGKGLEWVTFISYD<br>GNNKYYADSVKGRFTISRDNSKNTLYLQMNSLRAEDTAIYYCARTGWLGPFDYW<br>GQGTLVTVSS*GGGGSGGGGS*EVQLVESGGGLVQPGGSLRLSCAASGFNIKDTYI<br>*HWVRQAPGKCLEWVAEIYPTNGYTEYADSVKGRFTISADTSKNTAYLQMNSLRA<br>EDTAVYYCSRWGGDGFYAMDYWGQGTLVTVSS*DKTHTCPPCPAPELLGGPSVFL<br>FPPKPKDTLMISRTPEVTCVVVDVSHEDPEVKFNWYVDGVEVHNAKTKPREEQY<br>NSTYRVVSVLTVLHQDWLNGKEYKCKVSNKALPAPIEKTISKAKGQPREPQVYT<br>LPPCRDELTKNQVSLWCLVKGFYPSDIAVEWESNGQPENNYKTTPPVLDSDGSF<br>FLYSKLTVDKSRWQQGNVFSCSVMHEALHNHYTQKSLSLSPG | anti-CTLA4-VH-<br>(G4S)2-anti-<br>Her2-<br>(Trastuzumab-<br>G44C)-Var2)-VH-<br>Fc-<br>huIgG1(knob)<br>(SEQ ID NO: 65) |
| | EIVLTQSPATLSLSPGERATLSCRASQSVSSYLAWYQQKPGQAPRLLIYDASNR<br>ATGIPARFSGSGSGTDFTLTISSLEPEDFAVYYCQQSSNWPRTFGQGTKVEIKR<br>TVAAPSVFIFPPSDEQLKSGTASVVCLLNNFYPREAKVQWKVDNALQSGNSQES<br>VTEQDSKDSTYSLSSTLTLSKADYEKHKVYACEVTHQGLSSPVTKSFNRGEC | anti-PD1-VL-<br>huIGKC<br>(SEQ ID NO: 66) |
| | QVQLVESGGGVVQPGRSLRLDCKASGITFSNSGMHWVRQAPGKGLEWVAVIWYD<br>GSKRYYADSVKGRFTISRDNSKNTLFLQMNSLRAEDTAVYYCATNDDYWGQGTL<br>VTVSS*ASTKGPSVFPLAPSSKSTSGGTAALGCLVKDYFPEPVTVSWNSGALTSG<br>VHTFPAVLQSSGLYSLSSVVTVPSSSLGTQTYICNVNHKPSNTKVDKKVEPKSC<br>DKTHTCPPCPAPELLGGPSVFLFPPKPKDTLMISRTPEVTCVVVDVSHEDPEVK<br>FNWYVDGVEVHNAKTKPREEQYNSTYRVVSVLTVLHQDWLNGKEYKCKVSNKAL<br>PAPIEKTISKAKGQPREPQVCTLPPSRDELTKNQVSLSCAVKGFYPSDIAVEWE<br>SNGQPENNYKTTPPVLDSDGSFFLVSKLTVDKSRWQQGNVFSCSVMHEALHNRF<br>TQKSLSLSPG* | anti-PD1-VH-<br>huIgG1(hole-RF)<br>(SEQ ID NO: 67) |
| 28 | DIQMTQSPASLSVSVGDTITLTCHASQNIDVWLSWFQQKPGNIPKLLIYKASNL<br>HTGVPSRFSGSGSGTGFTLTISSLQPEDIATYYCQQAHSYPFTFGGGTKLEIK*G<br>GGGSGGGGS*DIQMTQSPSSLSASVGDRVTITCRASQDVNTAVAWYQQKPGKAPK<br>*WYSASFLYSGVPSRFSGSRSGTDFTLTISSLQPEDFATYYCQQHYTTPPTFGCG<br>TKVEIK* | anti-IL4-VL-<br>(G4S)2-anti-Her2-<br>(Trastuzumab-<br>Q100C)-VL<br>(SEQ ID NO: 68) |
| | QVQLQQSGPELVKPGASVKISCKASGYSFTSYWIHWIKQRPGQGLEWIGMIDPS<br>DGETRLNQRFQGRATLTVDESTSTAYMQLRSPTSEDSAVYYCTRLKEYGNYDSF<br>YFDVWGAGTLVTVSS*GGGGSGGGGGS*EVQLVESGGGLVQPGGSLRLSCAASGFNI<br>*KDTYIHWVRQAPGKCLEWVAEIYPTNGYTEYADSVKGRFTISADTSKNTAYLQM<br>NSLRAEDTAVYYCSRWGGDGFYAMDYWGQGTLVTVSS*DKTHTCPPCPAPELLGG<br>PSVFLFPPKPKDTLMISRTPEVTCVVVDVSHEDPEVKFNWYVDGVEVHNAKTKP<br>REEQYNSTYRVVSVLTVLHQDWLNGKEYKCKVSNKALPAPIEKTISKAKGQPRE<br>PQVYTLPPCRDELTKNQVSLWCLVKGFYPSDIAVEWESNGQPENNYKTTPPVLD<br>SDGSFFLYSKLTVDKSRWQQGNVFSCSVMHEALHNHYTQKSLSLSPG* | anti-IL4-VH-<br>(G4S)2-anti-<br>Her2-<br>(Trastuzumab-<br>G44C)-Var2)-VH-<br>Fc-<br>huIgG1(knob)<br>(SEQ ID NO: 68) |
| | DIVLTQSPASLAVSLGQRATISCRASESVDSYGQSYMHWYQQKAGQPPKLLIYL<br>ASNLESGVPARFSGSGSRTDFTLTIDPVQAEDAATYYCQQNAEDSRTFGGGTKL<br>EIKRTVAAPSVFIFPPSDEQLKSGTASVVCLLNNFYPREAKVQWKVDNALQSGN<br>SQESVTEQDSKDSTYSLSSTLTLSKADYEKHKVYACEVTHQGLSSPVTKSFNRG<br>EC | anti-IL13-VL-<br>huIGKC<br>(SEQ ID NO: 70) |
| | EVQLKESGPGLVAPGGSLSITCTVSGFSLTDSSINWVRQPPGKGLEWLGMIWGD<br>GRIDYADALKSRLSISKDSSKSQVFLEMTSLRTDDTATYYCARDGYFPYAMDFW<br>GQGTSVTVSS*ASTKGPSVFPLAPSSKSTSGGTAALGCLVKDYFPEPVTVSWNSG<br>ALTSGVHTFPAVLQSSGLYSLSSVVTVPSSSLGTQTYICNVNHKPSNTKVDKKV<br>EPKSCDKTHTCPPCPAPELLGGPSVFLFPPKPKDTLMISRTPEVTCVVVDVSHE<br>DPEVKFNWYVDGVEVHNAKTKPREEQYNSTYRVVSVLTVLHQDWLNGKEYKCKV<br>SNKALPAPIEKTISKAKGQPREPQVCTLPPSRDELTKNQVSLSCAVKGFYPSDI<br>AVEWESNGQPENNYKTTPPVLDSDGSFFLVSKLTVDKSRWQQGNVFSCSVMHEA<br>LHNRFQKSLSLSPG* | anti-IL13-VH-<br>huIgG1(hole-RF)<br>(SEQ ID NO: 71) |
| 29 | EIVLTQSPATLSLSPGERATLSCRASQSVSSYLAWYQQKPGQAPRLLIYDASNR<br>ATGIPARFSGSGSGTDFTLTISSLEPEDFAVYYCQQSSNWPRTFGQGTKVEIK*G<br>GGGSGGGGS*DIQMTQSPSSLSASVGDRVTITCRASQDVNTAWYQQKPGKAPKWY<br>*SASFLYSGVPSRFSGSRSGTDFTLTISSLQPEDFATYYCQQHYTTPPTFGCGTK<br>VEIK* | anti-PD1-VL-<br>(G4S)2-anti-Her2-<br>(Trastuzumab-<br>Q100C)-VL<br>(SEQ ID NO: 72) |
| | QVQLVESGGGVVQPGRSLRLDCKASGITFSNSGMHWVRQAPGKGLEWVAVIWYD<br>GSKRYYADSVKGRFTISRDNSKNTLFLQMNSLRAEDTAVYYCATNDDYWGQGTL<br>VTVSS*GGGGSGGGGS*EVQLVESGGGLVQPGGSLRLSCAASGFNIKDTYIHWVRQ<br>*APGKCLEWVAEIYPTNGYTEYADSVKGRFTISADTSKNTAYLQMNSLRAEDTAV<br>YYCSRWGGDGFYAMDYWGQGTLVTVSS*DKTHTCPPCPAPELLGGPSVFLFPPKP<br>KDTLMISRTPEVTCVVVDVSHEDPEVKFNWYVDGVEVHNAKTKPREEQYNSTYR<br>VVSVLTVLHQDWLNGKEYKCKVSNKALPAPIEKTISKAKGQPREPQVYTLPPCR<br>DELTKNQVSLWCLVKGFYPSDIAVEWESNGQPENNYKTTPPVLDSDGSFFLYSK<br>LTVDKSRWQQGNVFSCSVMHEALHNHYTQKSLSLSPG* | anti-PD1-VH-<br>(G4S)2-anti-<br>EHer2-<br>(Trastuzumab-<br>G44C)-Var2)-VH-<br>Fc-<br>huIgG1(knob)<br>(SEQ ID NO: 73) |
| | EIVLTQSPATLSLSPGERATLSCRASQSVSSYLAWYQQKPGQAPRLLIYDASNR<br>ATGIPARFSGSGSGTDFTLTISSLEPEDFAVYYCQQSSNWPRTFGQGTKVEIKR<br>TVAAPSVFIFPPSDEQLKSGTASVVCLLNNFYPREAKVQWKVDNALQSGNSQES<br>VTEQDSKDSTYSLSSTLTLSKADYEKHKVYACEVTHQGLSSPVTKSFNRGEC | anti-PD1-VL-<br>huIGKC<br>(SEQ ID NO: 74) |

TABLE 2-continued

Sequences of selected binding proteins

| ID | Sequence | Annotation: |
|---|---|---|
| | QVQLVESGGGVVQPGRSLRLDCKASGITFSNSGMHWVRQAPGKGLEWVAVIWYD GSKRYYADSVKGRFTISRDNSKNTLFLQMNSLRAEDTAVYYCATNDDYWGQGTL VTVSSASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKKVEPKSC DKTHTCPPCPAPELLGGPSVFLFPPKPKDTLMISRTPEVTCVVVDVSHEDPEVK FNWYVDGVEVHNAKTKPREEQYNSTYRVVSVLTVLHQDWLNGKEYKCKVSNKAL PAPIEKTISKAKGQPREPQVCTLPPSRDELTKNQVSLSCAVKGFYPSDIAVEWE SNGQPENNYKTTPPVLDSDGSFFLVSKLTVDKSRWQQGNVFSCSVMHEALHNRF TQKSLSLSPG | anti-PD1-VH-huIgG1(hole-RF) (SEQ ID NO: 75) |
| | DIQMTQSPSSLSASVGDRVTITCRASQDVNTAVAWYQQKPGKAPKWYSASFLYS GVPSRFSGSRSGTDFTLTISSLQPEDFATYYCQQHYTTPPTFGCGTKVEIK | VLX dsVariable light chain sequence of Trastuzumab SEQ ID NO: 76 |
| dsTrasKO 1 | EVQLVESGGGLVQPGGSLRLSCAASGFNIKDTAIHWVRQAPGKCLEWWVAEIYP TNGYTEYADSVKGRFTISADTSKNTAYLQMNSLRAEDTAVYYCSRWGGDGFAAM DYWGQGTLVTVSS | VHX Variable heavy chain sequence of trastuzumab variant 1. SEQ ID NO: 77 |
| dsTrasKO 2 | EVQLVESGGGLVQPGGSLRLSCAASGFNIKDTYIGHWVRQAPGKCLEWVAEIYP TNGYTEYADSVKGRFTISADTSKNTAYLQMNSLRAEDTAVYYCSRWGGDGFYAM DYWGQGTLVTVSS | VHX Variable heavy chain sequence of trastuzumab variant 2. SEQ ID NO: 78 |
| dsTrasKO 3 | EVQLVESGGGLVQPGGSLRLSCAASGFNIKTAIHWVRQAPGKCLEWVARIYPT NGYTRYADSVKGRFTISADTSKNTAYLQMNSLRAEDTAVYYCSRWGGDGFAAMD YWGQGLTVTVSS | VHX Variable heavy chain sequence of trastuzumab variant 3. SEQ ID NO: 79 |

TABLE 3

Sequences of bispecific T cell engager antibodies

| ID | LC1 Sequence | HC1 Sequence | HC2 Sequence | LC2 Sequence |
|---|---|---|---|---|
| 30 anti-TCR α/β x anti-CD123 Wild Type SEQ ID NO: 80 | QIVLTQSPAIMSASPG EKVTMTCSATSSVSYM HWYQQKSGTSPKRWIY DTSKLASGVPARFSGS GSGTSYSLTISSMEAE DAATYYCQQWSSNPLT FGAGTKLELKRTVAAP SVFIFPPSDEQLKSGT ASVVCLLNNFYPREAK VQWKVDNALQSGNSQE SVTEQDSKDSTYSLSS TLTLSKADYEKHKVYA CEVTHQGLSSPVTKSF NRGEC | EVQLQQSGPELVKPGASV KMSCKASGYKFTSYVMHW VKQKPGQGLEWIGYINPY NDVTKYNEKFKGKATLTS DKSSSTAYMELSSLTSED SAVYYCARGSYYDYDGFV YWGQGTLVTVSAASTKGP SVFPLAPSSKSTSGGTAA LGCLVKDYFPEPVTVSWN SGALTSGVHTFPAVLQSS GLYSLSSVVTVPSSSLGT QTYICNVNHKPSNTKVDK KVEPKSCDKTHTCPPCPA PEAAGGPSVFLFPPKPKD TLMISRTPEVTCVVVDVS HEDPEVKFNWYVDGVEVH NAKTKPREEQYNSTYRVV SVLTVLHQDWLNGKEYKC KVSNKALPAPIEKTISKA KGQPREPQVYTLPPCRDE LTKNQVSLWCLVKGFYPS DIAVEWESNGQPENNYKT TPPVLDSDGSFFLYSKLT VDKSRWQQGNVFSCSVMH EALHNHYTQKSLSLSPG | EVQLQQSGPELVKPGASV MSCKASGYTFTDYYMKWVK QSHGKSLEWIGDIIPSNGA TFYNQKFKGKATLTVDRSS STAYMLNSLTSEDSAVYY CTRSHLLRASWFAYWGQGT LVTVSAASTKGPSVFPLAP SSKSTSGGTAALGCLVKDY FPEPVTVSWNSGALTSGVH TFPAVLQSSGLYSLSSVVT VPSSSLGTQTYICNVNHKP SNTKVDKKVEPKSCDKTHT CPPCPAPEAAGGPSVFLFP PKPKDTLMISRTPEVTCVV VDVSHEDPEVKFNWYVDGV EVHNAKTKPREEQYNSTYR VVSVLTVLHQDWLNGKEYK CKVSNKALPAPIEKTISKA KGQPREPQVCTLPPSRDEL TKNQVSLSCAVKGFYPSDI AVEWESNGQPENNYKTTPP VLDSDGSFFLVSKLTVDKS RWQQGNVFSCSVMHEALHN RFTQKSLSLSPG | DFVMTQSPSSLTVTAGE KVTMSCKSSQSLLNSGN QKNYLTWYLQKPGQPPK LLIYWASTRESGVPDRF TGSGSGTDFTLTISSVQ AEDLAVYYCQNDYSYPY TFGGGTKLEIKRTVAAP SVFIFPPSDEQLKSGTA SVVCLLNNFYPREAKVQ WKVDNALQSGNSQESVT EQDSKDSTYSLSSTLTL SKADYEKHKVYACEVTH QGLSSPVTKSFNRGEC |

TABLE 3-continued

Sequences of bispecific T cell engager antibodies

| ID | LC1 Sequence | HC1 Sequence | HC2 Sequence | LC2 Sequence |
|---|---|---|---|---|
| 31 anti-TCR α/β x anti-CD123 dsTrasK 02 SEQ ID NO: 81 | QIVLTQSPAIMSASPGEKVTMTCSATSSVSYMHWYQQKSGTSPKRWIYDTSKLASGVPARFSGSGSGTSYSLTISSMEADAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | EVQLQQSGPELVKPGASVKMSCKASGYKFTSYVMHWVKQPGQGLEWIGYINPYNDVTKYNEKFKGKATLTSDKSSSTAYMELSSLTSEDSAVHYCARGSYYDYDGFVYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG | EVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG | DFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK |
| 32 anti-TCR α/β-dsTrasK 02 x anti-CD123 SEQ ID NO: 82 | QIVLTQSPAIMSASPGEKVTMTCSATSSVSYMHWYQQKSGTSPKRWIYDTSKLASGVPARFSGSGSGTSYSLTISSMEADAATYYCQQWSSNPLTFGAGTKLELKGGGGSGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK | EVQLQQSGPELVKPGASVKMSCKASGYKFTSYVMHWVKQPGQGLEWIGYINPYNDVTKYNEKFKGKATLTSDKSSSTAYMELSSLTSEDSAVHYCARGSYYDYDGFVYWGQGTLVTVSAGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG | EVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG | DFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 33 anti-CD3ε x anti-CD123 Wild Type SEQ ID NO: 83 | DIQLTQSPAIMSASPGEKVTMTCRASSSVSYMNWYQQKSGTSPKRWIYDTSKVASGVPYRFSGSGSGTSYSLTISSMEADAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDEL | EVQLQQSGPELVKPGASVKMSCKASGYTFTDYYMKSVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDI | DFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |

TABLE 3-continued

Sequences of bispecific T cell engager antibodies

| ID | LC1 Sequence | HC1 Sequence | HC2 Sequence | LC2 Sequence |
|---|---|---|---|---|
| | | TKNQVSLWCLVKGFYPSD IAVEWESNGQPENNYKTT PPVLDSDGSFFLYSKLTV DKSRWQQGNVFSCSVMHE ALHNHYTQKSLSLSPG | AVEWESNGQPENNYKTTPP VLDSDGSFFLVSKLTVDKS RWQQGNVFSCSVMHEALHN RFTQKSLSLSPG | |
| 34 anti-CD3ε x anti-CD123-dsTrasK O2 SEQ ID NO: 84 | DIQLTQSPAIMSASPG EKVTMTCRASSSVSYM NWYQQKSGTSPKRWIY DTSKVASGVPYRFSGS GSGTSYSLTISSMEAE DAATYYCQQWSSNPLT FGAGTKLELKRTVAAP SVFIFPPSDEQLKSGT ASVVCLLNNFYPREAK VQWKVDNALQSGNSQE SVTEQDSKDSTYSLSS TLTLSKADYEKHKVYA CEVTHQGLSSPVTKSF NRGEC | DIKLQQSGAELARPGASV KMSCKTSGYTFTRYTMHW VKQRPGQGLEWIGYINPS RGYTNYNQKFKDKATLTT DKSSSTAYMQLSSLTSED SAVYYCARYYDDHYCLDY WGQGTTLTVSSASTKGPS VFPLAPSSKSTSGGTAAL GCLVKDYFPEPVTVSWNS GALTSGVHTFPAVLQSSG LYSLSSVVTVPSSSLGTQ TYICNVNHKPSNTKVDKK VEPKSCDKTHTCPPCPAP EAAGGPSVFLFPPKPKDT LMISRTPEVTCVVVDVSH EDPEVKFNWYVDGVEVHN AKTKPREEQYNSTYRVVS VLTVLHQDWLNGKEYKCK VSNKALPAPIEKTISKAK GQPREPQVYTLPPCRDEL TKNQVSLWCLVKGFYPSD IAVEWESNGQPENNYKTT PPVLDSDGSFFLYSKLTV DKSRWQQGNVFSCSVMHE ALHNHYTQKSLSLSPG | EVQLQQSGPELVKPGASVK MSCKASGYTFTDYYMKWVK QSHGKSLEWIGDIIPSNGA TFYNQKFKGKATLTVDRSS STAYMHLNSLTSEDSAVYY CTRSHLLRASWFAYWGQGT LVTVSAGGGSGGGGSEVQ LVESGGGLVQPGGSLRLSC AASGFNIKDTYIHWVRQAP GKCLEWVAEYPTNGYTEYA DSVKGRFTISADTSKNTAY LQMNSLRAEDTAVYYCSRW GGDGFYAMDYWGQGTLVTV SSDKTHTCPPCPAPEAAGG PSVFLFPPKPKDTLMISRT PEVTCVVVDVSHEDPEVKF NWYVDGVEVHNAKTKPREE QYNSTYRVVSVLTVLHQDW LNGKEYKCKVSNKALPAPI EKTISKAKGQPREPQVCTL PPSRDELTKNQVSLSCAVK GFYPSDIAVEWESNGQPEN NYKTTPPVLDSGSFFLVS KLTVDKSRWQQGNVFSCSV MHEALHNRFTQKSLSLSPG | DFVMTQSPSSLTVTAGE KVTMSCKSSQSLLNSGN QKNYLTWYLQKPGQPPK LLIYWASTRESGVPDRF TGSGSGTDFTLTISSVQ AEDLAVYYCQNDYSYPY TFGGGTKLEIKGGGGS GGGGSDIQMTQSPSSLSA ISVGDRVTITCRASQDV NTAVAWYQQKPGKAPKL LIYSASFLYSGVPSRFS GSRSGTDFTLTISSLQP EDFATYYCQQHYTTPPT FGCGTKVEIK |
| 35 anti-CD3ε x dsTrasK O2 x anti-CD123 SEQ ID NO: 85 | DIQLTQSPAIMSASPG EKVTMTCRASSSVSYM NWYQQKSGTSPKRWIY DTSKVASGVPYRFSGS GSGTSYSLTISSMEAE DAATYYCQQWSSNPLT FGAGTKLELKGGGGS GGGGSDIQMTQSPSSLS ASVGDRVTITCRASQD VNTAVAWYQQKPGKAP KLLIYSASFLYSGVPS RFSGSRSGTDFTLTIS SLQPEDFATYYCQQHY TTPPTFGCGTKVEIK | DIKLQQSGAELARPGASV KMSCKTSGYTFTRYTMHW VKQRPGQGLEWIGYINPS RGYTNYNQKFKDKATLTT DKSSSTAYMQLSSLTSED SAVYYCARYYDDHYCLDY WGQGTTLTVSSGGGGSGG GGSEVQLVESGGGLVQPG GSLRLSCAASGFNIKDTY IHWVRQAPGKCLEWVAEI YPTNGYTEYADSVKGRFT ISADTSKNTAYLQMNSLR AEDTAVYYCSRWGGDGFY AMDYWGQGTLVTVSSDKT HTCPPCPAPEAAGGPSVF LFPPKPKDTLMISRTPEV TCVVVDVSHEDPEVKFNW YVDGVEVHNAKTKPREEQ YNSTYRVVSVLTVLHQDW LNGKEYKCKVSNKALPAP IEKTISKAKGQPREPQVY TLPPCRDELTKNQVSLWC LVKGFYPSDIAVEWESNG QPENNYKTTPPVLDSDGS FFLYSKLTVDKSRWQQGN VFSCSVMHEALHNHYTQK SLSLSPG | EVQLQQSGPELVKPGASVK MSCKASGYTFTDYYMKWVK QSHGKSLEWIGDIIPSNGA TFYNQKFKGKATLTVDRSS STAYMHLNSLTSEDSAVYY CTRSHLLRASWFAYWGQGT LVTVSAASTKGPSVFPLAP SSKSTSGGTAALGCLVKDY FPEPVTVSWNSGALTSGVH TFPAVLQSSGLYSLSSVVT VPSSSLGTQTYICNVNHKP SNTKVDKKVEPKSCDKTHT CPPCPAPEAAGGPSVFLFP PKPKDTLMISRTPEVTCVV VDVSHEDPEVKFNWYVDGV EVHNAKTKPREEQYNSTYR VVSVLTVLHQDWLNGKEYK CKVSNKALPAPIEKTISKA KGQPREPQVCTLPPSRDEL TKNQVSLSCAVKGFYPSDI AVEWESNGQPENNYKTTPP VLDSDGSFFLVSKLTVDKSR WQQGNVFSCSVMHEALHNRF TQKSLSLSPG | DFVMTQSPSSLTVTAGE KVTMSCKSSQSLLNSGN QKNYLTWYLQKPGQPPK LLIYWASTRESGVPDRF TGSGSGTDFTLTISSVQ AEDLAVYYCQNDYSYPY TFGGGTKLEIKRTVAAP SVFIFPPSDEQLKSGTA SVVCLLNNFYPREAKVQ WKVDNALQSGNSQESVT EQDSKDSTYSLSSTLTL SKADYEKHKVYACEVTH QGLSSPVTKSFNRGEC |
| 36 anti-CD3ε x anti-CD123 Wild Type SEQ ID NO: 86 | DIVMTQTPLSLSVTPG QPASISCKSSQSLVHE NLQTYLSWYLQKPGQS PQSLIYKVSNRFSGVP DRFSGSGSGTDFTLKI SRVEAEDVGVYYCGQG TQYPFTFGSGTKVEIK RTVAAPSVFIFPPSDE QLKSGTASVVCLLNNF YPREAKVQWKVDNALQ SGNSQESVTEQDSKDS TYSLSSTLTLSKADYE KHKVYACEVTHQGLSS PVTKSFNRGEC | QVQLVESGGGVVQPGRSL RLSCAASGFTFTYKAWMHW VRQAPGKQLEWVAQIKDK SNSYATYYADSVKGRFTI SRDDSKNTLYLQMNSLRA EDTAVYYCRGVYYALSPF DYWGQGTLVTVSSASTKG PSVFPLAPSSKSTSGGTA ALGCLVKDYFPEPVTVSW NSGALTSGVHTFPAVLQS SGLYSLSSVVTVPSSSLG TQTYICNVNHKPSNTKVD KKVEPKSCDKTHTCPPCP APEAAGGPSVFLFPPKPK DTLMISRTPEVTCVVVDV | EVQLQQSGPELVKPGASVK MSCKASGYTFTDYYMKWVK QSHGKSLEWIGDIIPSNGA TFYNQKFKGKATLTVDRSS STAYMHLNSLTSEDSAVYY CTRSHLLRASWFAYWGQGT LVTVSAASTKGPSVFPLAP SSKSTSGGTAALGCLVKDY FPEPVTVSWNSGALTSGVH TFPAVLQSSGLYSLSSVVT VPSSSLGTQTYICNVNHKP SNTKVDKKVEPKSCDKTHT CPPCPAPEAAGGPSVFLFP PKPKDTLMISRTPEVTCVV VDVSHEDPEVKFNWYVDGV | DFVMTQSPSSLTVTAGE KVTMSCKSSQSLLNSGN QKNYLTWYLQKPGQPPK LLIYWASTRESGVPDRF TGSGSGTDFTLTISSVQ AEDLAVYYCQNDYSYPY TFGGGTKLEIKRTVAAP SVFIFPPSDEQLKSGTA SVVCLLNNFYPREAKVQ WKVDNALQSGNSQESVT EQDSKDSTYSLSSTLTL SKADYEKHKVYACEVTH QGLSSPVTKSFNRGEC |

TABLE 3-continued

Sequences of bispecific T cell engager antibodies

| ID | LC1 Sequence | HC1 Sequence | HC2 Sequence | LC2 Sequence |
|---|---|---|---|---|
| | | SHEDPEVKFNWYVDGVEV HNAKTKPREEQYNSTYRV VSVLTVLHQDWLNGKEYK CKVSNKALPAPIEKTISK AKGQPREPQVYTLPPCRD ELTKNQVSLWCLVKGFYP SDIAVEWESNGQPENNYK TTPPVLDSDGSFFLYSKL TVDKSRWQQGNVFSCSVM HEALHNHYTQKSLSLSPG | EVHNAKTKPREEQYNSTYR VVSVLTVLHQDWLNGKEYK CKVSNKALPAPIEKTISKA KGQPREPQVCTLPPSRDEL TKNQVSLSCAVKGFYPSDI AVEWESNGQPENNYKTTPP VLDSDGSFFLVSKLTVDKS RWQQGNVFSCSVMHEALHN RFTQKSLSLSPG | |
| 37 anti-CD3ϵ x anti-CD123-dsTrasK O2 SEQ ID NO: 87 | DIVMTQTPLSLSVTPG QPASISCKSSQSLVHE NLQTYLSWYLQKPGQS PQSLIYKVSNRFSGVP DRFSGSGSGTDFTLKI SRVEAEDVGVYYCGQG TQYPFTFGSGTKVEIK RTVAAPSVFIFPPSDE QLKSGTASVVCLLNNF YPREAKVQWKVDNALQ SGNSQESVTEQDSKDS TYSLSSTLTLSKADYE KHKVYACEVTHQGLSS PVTKSFNRGEC | QVQLVESGGGVVQPGRSL RLSCAASGFTFTKAWMHW VRQAPGKQLEWVAQIKDK SNSYATYYADSVKGRFTI SRDDSKNTLYLQMNSLRA EDTAVYYCRGVYYALSPF DYWGQGTLVTVSSASTKG PSVFPLAPSSKSTSGGTA ALGCLVKDYFPEPVTVSW NSGALTSGVHTFPAVLQS SGLYSLSSVVTVPSSSLG TQTYICNVNHKPSNTKVD KKVEPKSCDKTHTCPPCP APEAAGGPSVFLFPPKPK DTLMISRTPEVTCVVVDV SHEDPEVKFNWYVDGVEV HNAKTKPREEQYNSTYRV VSVLTVLHQDWLNGKEYK CKVSNKALPAPIEKTISK AKGQPREPQVYTLPPCRD ELTKNQVSLWCLVKGFYP SDIAVEWESNGQPENNYK TTPPVLDSDGSFFLYSKL TVDKSRWQQGNVFSCSVM HEALHNHYTQKSLSLSPG | EVQLQQSGPELVKPGASVK MSCKASGYTFTDYYMKWVK QSHGKSLEWIGDIIPSNGA TFYNQKFKGKATLTVDRSS STAYMHLNSLTSEDSAVYY CTRSHLLRASWFAYWGQGT LVTVSAGGGGSGGGGSEVQ LVESGGGLVQPGGSLRLSC AASGFNIKDTYIHWVRQAP GKCLEWVAEYPTNGYTEYA DSVKGRFTISADTSKNTAY LQMNSLRAEDTAVYYCSRW GGDGFYAMDYWGQGTLVTV SSDKTHTCPPCPAPEAAGG PSVFLFPPKPKDTLMISRT PEVTCVVVDVSHEDPEVKF NWYVDGVEVHNAKTKPREE QYNSTYRVVSVLTVLHQDW LNGKEYKCKVSNKALPAPI EKTISKAKGQPREPQVCTL PPSRDELTKNQVSLSCAVK GFYPSDIAVEWESNGQPEN NYKTTPPVLDSDGSFFLVS KLTVDKSRWQQGNVFSCSV MHEALHNRFTQKSLSLSPG | DFVMTQSPSSLTVAGE KVTMSCKSSQSLLNSGN QKNYLTWYLQKPGQPPK LLIYWASTRESGVPDRF TGSGSGTDFTLTISSVQ AEDLAVYYCQNDYSYPY TFGGGTKLEIKGGGGSG GGGSDIQMTQSPSSLSA ISVGDRVTITCRASQDV NTAVAWYQQKPGKAPKL LIYSASFLYSGVPSRFS GSRSGTDFTLTISSLQP EDFATYYCQQHYTTPPT FGCGTKVEIK |
| 38 anti-CD3ϵ-dsTrasK OX x anti-CD123 SEQ ID NO: 88 | DIVMTQTPLSLSVTPG QPASISCKSSQSLVHE NLQTYLSWYLQKPGQS PQSLIYKVSNRFSGVP DRFSGSGSGTDFTLKI SRVEAEDVGVYYCGQG TQYPFTFGSGTKVEIK GGGGSGGGGSDIQMTQ SPSSLSASVGDRVTIT CRASQDVNTAVAWYQQ KPGKAPKLLIYSASFL YSGVPSRFSGSRSGTD FTLTISSLQPEDFATY YCQQHYTTPPTFGCGT KVEK | QVQLVESGGGVVQPGRSL RLSCAASGFTFTKAWMHV VVRQAPGKQLEWVAQIKD KSNSYATYYADSVKGRFT ISRDDSKNTLYLQMNSLR AEDTAVYYCRGVYYALSP FDYWGQGTLVTVSSGGGG SGGGGSEVQLVESGGGLV QPGGSLRLSCAASGFNIK DTYIHWVRQAPGKCLEVV VAEIYPTNGYTEYADSVK GRFTISADTSKNTAYLQM NSLRAEDTAVYYCSRWGG DGFYAMDYWGQGTLVTVS SDKTHTCPPICPAPEAAG GPSVFLFPPKPKDTLMIS RTPEVTCVVVDVSHEDPE VKFNWYVDGVEVHNAKTK PREEQYNSTYRVVSVLTV LHQDWLNGKEYKCKVSNK ALPAPIEKTISKAKGQPR EPQVYTLPPCRDELTKNQ VSLWCLVKGFYPSDIAVE WESNGQPENNYKTTPPVL DSDGSFFLYSKLTVDKSR WQQGNVFSCSVMHEALHN HYTQKSLSLSPG | EVQLQQSGPELVKPGASVK MSCKASGYTFTDYYMKWVK QSHGKSLEWIGDIIPSNGA TFYNQKFKGKATLTVDRSS STAYMHLNSLTSEDSAVYY CTRSHLLRASWFAYWGQGT LVTVSAASTKGPSVFPLAP SSKSTSGGTAALGCLVKDY FPEPVTVSWNSGALTSGVH TFPAVLQSSGLYSLSSVVT VPSSSLGTQTYICNVNHKP SNTKVDKKVEPKSCDKTHT CPPCPAPEAAGGPSVFLFP PKPKDTLMISRTPEVTCVV VDVSHEDPEVKFNWYVDGV EVHNAKTKPREEQYNSTYR VVSVLTVLHQDWLNGKEYK CKVSNKALPAPIEKTISKA KGQPREPQVCTLPPSRDEL TKNQVSLSCAVKGFYPSDI AVEWESNGQPENNYKTTPP VLDSDGSFFLVSKLTVDKS RWQQGNVFSCSVMHEALHN RFTQKSLSLSPG | DFVMTQSPSSLTVAGE KVTMSCKSSQSLLNSGN QKNYLTWYLQKPGQPPK LLIYWASTRESGVPDRF TGSGSGTDFTLTISSVQ AEDLAVYYCQNDYSYPY TFGGGTKLEIKRTVAAP SVFIFPPSDEQLKSGTA SVVCLLNNFYPREAKVQ WKVDNALQSGNSQESVT EQDSKDSTYSLSSTLTL SKADYEKHKVYACEVTH QGLSSPVTKSFNRGEC |
| 39 anti-TCR α/β x anti-TNP Negative control Wild Type SEQ ID NO: 89 | QIVLTQSPAIMSASPG EKVTMTCSATSSVSYM HWYQQKSGTSPKRWIY DTSKLASGVPARFSGS GSGTSYSLTISSMEAE DAATYYCQQWSSNPLT FGAGTKLELKRTVAAP SVFIFPPSDEQLKSGT ASVVCLLNNFYPREAK VQWKVDNALQSGNSQE | EVQLQQSGPELVKPGASV KMSCKASGYKFTSYVMHW VKQKPGQGLEWIGYINPY NDVTKYNEKFKGKATLTS DKSSSTAYMELSSLTSED SAVHYCARGSYYDYDGFV YWGQGTLVTVSSASTKGP SVFPLAPSSKSTSGGTAA LGCLVKDYFPEPVTVSWN SGALTSGVHTFPAVLQSS | QIQLVQSGSELKKPGASVK VSCKASGYTFTNYGMNWVR QAPGQGLEWVGWINTYTGG PKYAQGFTGRFVFSVDTSV STAYLQISSLKAEDTAVYY CARGIYDGYHWYFDVWRGG TLVTVSSASTKGPSVFPLA PSSKSTSGGTAALGCLVKD YFPEPVTVSWNSGALTSGV HTFPAVLQSSGLYSLSSVV | DVVMTQSPLSLPVTLGQ PASISCRSSQSLVHSIG NTYLHWYQQRPGQSPRL LIYKVSNRFSGVPDRFS GSGSGTDFTLKISRVEA EDVGVYYCSQSTHVPFT FGGGTKLEIKRTVAAPS VFIFPPSDEQLKSGTAS VVCLLNNFYPREAKVQW KVDNALQSGNSQESVTE |

TABLE 3-continued

Sequences of bispecific T cell engager antibodies

| ID | LC1 Sequence | HC1 Sequence | HC2 Sequence | LC2 Sequence |
|---|---|---|---|---|
| | SVTEQDSKDSTYSLSSTLTLSKADYEKHKVYACEVTHQGLSSPVTKSFNRGEC | GLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG | TVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG | QDSKDSTYSLSSTLTLSKADYEKHKVYACEVTHQGLSSPVTKSFNRGEC |
| 40 anti-TCR α/β x anti-TNP-dsTrasK 02 Negative control SEQ ID NO: 90 | QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | EVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG | QIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWRGQTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLCAVKGFYPSDIAVEWESNGQPENNYKTTPPVLDSDGSFFLVSKLTVDKSRWQQGNVFSCSVMHEALHNRFTQKSLSLSPG | DVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK |
| 41 anti-TCR α/β-dsTrasK 02 x anti-TNP Negative control SEQ ID NO: 91 | QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK | EVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAGGGGSGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG | QIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWRGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG | DVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 42 anti-TNP x anti-CD123 | DVVMTQSPLSLPVTLGQPASISCRSSQSLVHSIGNTYLHWYQQRPGQSPRLLIYKVSNRFSGVP | QIQVQSGSELKKPGASVKVSCKASGYTFTNYGMNWVRQAPGQGLEWVGWINTYTGGPKYAQGFTGRFVFSV | EVQLQQSGPELVKPGASVKMSCKASGYTFTDYYMKWVKQSHGKSLEWIGDIIPSNGATFYNQKFKGKATLTVDRSS | DFVMTQSPSSLTVTAGEKVTMSCKSSQSLLNSGNQKNYLTWYLQKPGQPPKLLIYWASTRESGVPDRF |

TABLE 3-continued

Sequences of bispecific T cell engager antibodies

| ID | LC1 Sequence | HC1 Sequence | HC2 Sequence | LC2 Sequence |
|---|---|---|---|---|
| Negative control Wild Type SEQ ID NO: 92 | DRFSGSGSGTDFTLKI SRVEAEDVGVYYCSQS THVPFTFGQGTKLEIK RTVAAPSVFIFPPSDE QLKSGTASVVCLLNNF YPREAKVQWKVDNALQ SGNSQESVTEQDSKDS TYSLSSTLTLSKADYE KHKVYACEVTHQGLSS PVTKSFNRGEC | DTSVSTAYLQISSLKAED TAVYYCARGIYDGYHWYF DVWGRGTLVTVSSASTKG PSVFPLAPSSKSTSGGTA ALGCLVKDYFPEPVTVSW NSGALTSGVHTFPAVLQS SGLYSLSSVVTVPSSSLG TQTYICNVNHKPSNTKVD KKVEPKSCDKTHTCPPCP APEAAGGPSVFLFPPKPK DTLMISRTPEVTCVVVDV SHEDPEVKFNWYVDGVEV HNAKTKPREEQYNSTYRV VSVLTVLHQDWLNGKEYK CKVSNKALPAPIEKTISK AKGQPREPQVYTLPPCRD ELTKNQVSLWCLVKGFYP SDIAVEWESNGQPENNYK TTPPVLDSDGSFFLYSKL TVDKSRWQQGNVFSCSVM HEALHNHYTQKSLSLSPG | STAYMHLNSLTSEDSAVYY CTRSHLLRASWFAYWGQGT LVTVSAASTKGPSVFPLAP SSKSTSGGTAALGCLVKDY FPEPVTVSWNSGALTSGVH TFPAVLQSSGLYSLSSVVT VPSSSLGTQTYICNVNHKP SNTKVDKKVEPKSCDKTHT CPPCPAPEAAGGPSVFLFP PKPKDTLMISRTPEVTCVV VDVSHEDPEVKFNWYVDGV EVHNAKTKPREEQYNSTYR VVSVLTVLHQDWLNGKEYK CKVSNKALPAPIEKTISKA KGQPREPQVCTLPPSRDEL TKNQVSLSCAVKGFYPSDI AVEWESNGQPENNYKTTPP VLDSDGSFFLVSKLTVDKS RWQQGNVFSCSVMHEALHN RFTQKSLSLSPG | TGSGSGTDFTLTISSVQ AEDLAVYYCQNDYSYPY TFGGGTKLEIKRTVAAP SVFIFPPSDEQLKSGTA SVVCLLNNFYPREAKVQ WKVDNALQSGNSQESVT EQDSKDSTYSLSSTLTL SKADYEKHKVYACEVTH QGLSSPVTKSFNRGEC |
| 43 anti-TNP x anti-CD123 dsTrasK O2 Negative control SEQ ID NO: 93 | DVVMTQSPLSLPVTLG QPASISCRSSQSLVHS IGNTYLHWYQQRPGQS PRLLIYKVSNRFSGVP DRFSGSGSGTDFTLKI SRVEAEDVGVYYCSQS THVPFTFGQGTKLEIK RTVAAPSVFIFPPSDE QLKSGTASVVCLLNNF YPREAKVQWKVDNALQ SGNSQESVTEQDSKDS TYSLSSTLTLSKADYE KHKVYACEVTHQGLSS PVTKSFNRGEC | QIQLVQSGSELKKPGASV KVSCKASGYTFTNYGMNW VRQAPGQGLEWVGWINTY TGGPKYAQGFTGRFVFSV DTSVSTAYLQISSLKAED TAVYYCARGIYDGYHWYF DVWGRGTLVTVSSASTKG PSVFPLAPSSKSTSGGTA ALGCLVKDYFPEPVTVSW NSGALTSGVHTFPAVLQS SGLYSLSSVVTVPSSSLG TQTYICNVNHKPSNTKVD KKVEPKSCDKTHTCPPCP APEAAGGPSVFLFPPKPK DTLMISRTPEVTCVVVDV SHEDPEVKFNWYVDGVEV HNAKTKPREEQYNSTYRV VSVLTVLHQDWLNGKEYK CKVSNKALPAPIEKTISK AKGQPREPQVYTLPPCRD ELTKNQVSLWCLVKGFYP SDIAVEWESNGQPENNYK TTPPVLDSDGSFFLYSKL TVDKSRWQQGNVFSCSVM HEALHNHYTQKSLSLSPG | EVQLQQSGPELVKPGASVK MSCKASGYTFTDYYMKWVK QSHGKSLEWIGDIIPSNGA TFYNQKFKGKATLTVDRSS STAYMHLNSLTSEDSAVYY CTRSHLLRASWFAYWGQGT LVTVSAGGGSGGGGSEVQ LVESGGGLVQPGGSLRLSC AASGFNIKDTYIHWVRQAP GKCLEWVAEYPTNGYTEYA DSVKGRFTISADTSKNTAY LQMNSLRAEDTAVYYCSRW GGDGFYAMDYWGQGTLVTV SSDKTHTCPPCPAPEAAGG PSVFLFPPKPKDTLMISRT PEVTCVVVDVSHEDPEVKF NWYVDGVEVHNAKTKPREE QYNSTYRVVSVLTVLHQDW LNGKEYKCKVSNKALPAPI EKTISKAKGQPREPQVCTL PPSRDELTKNQVSLSCAVK GFYPSDIAVEWESNGQPEN NYKTTPPVLDSDGSFFLVS KLTVDKSRWQQGNVFSCSV MHEALHNRFTQKSLSLSPG | DFVMTQSPSSLTVTAGE KVTMSCKSSQSLLNSGN QKNYLTWYLQKPGQPPK LLIYWASTRESGVPDRF TGSGSGTDFTLTISSVQ AEDLAVYYCQNDYSYPY TFGGGTKLEIKGGGGSG GGGSDIQMTQSPSSLSA ISVGDRVTITCRASQDV NTAVAWYQQKPGKAPKL LIYSASFLYSGVPSRFS GSRSGTDFTLTISSLQP EDFATYYCQQHYTTPPT FGCGTKVEIK |
| 44 anti-TNP-dsTrasK O2 x anti-CD123 Negative control SEQ ID NO: 94 | DVVMTQSPLSLPVTLG QPASISCRSSQSLVHS IGNTYLHWYQQRPGQS PRLLIYKVSNRFSGVP DRFSGSGSGTDFTLKI SRVEAEDVGVYYCSQS THVPFTFGQGTKLEIK GGGGSGGGGSDIQMTQ SPSSLSASVGDRVTIT CRASQDVNTAVAWYQQ KPGKAPKLLIYSASFL YSGVPSRFSGSRSGTD FTLTISSLQPEDFATY YCQQHYTTPPTFGCGT KVEK | QIQLVQSGSELKKPGASV KVSCKASGYTFTNYGMNW VRQAPGQGLEWVGWINTY TGGPKYAQGFTGRFVFSV DTSVSTAYLQISSLKAED TAVYYCARGIYDGYHWYF DVWGRGTLVTVSSGGGGS GGGGSEVQLVESGGGLVQ PGGSLRLSCAASGFNIKD TYIHWVRQAPGKCLEWVA EIYPTNGYTEYADSVKGR FTISADTSKNTAYLQMNS LRAEDTAVYYCSRWGGDG FYAMDYWGQGTLVTVSSD KTHTCPPICPAPEAAGGP SVFLFPPKPKDTLMISRT PEVTCVVVDVSHEDPEVK FNWYVDGVEVHNAKTKPR EEQYNSTYRVVSVLTVLH QDWLNGKEYKCKVSNKAL PAPIEKTISKAKGQPREP QVYTLPPCRDELTKNQVS LWCLVKGFYPSDIAVEWE SNGQPENNYKTTPPVLDS DGSFFLYSKLTVDKSRWQ QGNVFSCSVMHEALHNHY TQKSLSLSPG | EVQLQQSGPELVKPGASVK MSCKASGYTFTDYYMKWVK QSHGKSLEWIGDIIPSNGA TFYNQKFKGKATLTVDRSS STAYMHLNSLTSEDSAVYY CTRSHLLRASWFAYWGQGT LVTVSAASTKGPSVFPLAP SSKSTSGGTAALGCLVKDY FPEPVTVSWNSGALTSGVH TFPAVLQSSGLYSLSSVVT VPSSSLGTQTYICNVNHKP SNTKVDKKVEPKSCDKTHT CPPCPAPEAAGGPSVFLFP PKPKDTLMISRTPEVTCVV VDVSHEDPEVKFNWYVDGV EVHNAKTKPREEQYNSTYR VVSVLTVLHQDWLNGKEYK CKVSNKALPAPIEKTISKA KGQPREPQVCTLPPSRDEL TKNQVSLSCAVKGFYPSDI AVEWESNGQPENNYKTTPP VLDSDGSFFLVSKLTVDKS RWQQGNVFSCSVMHEALHN RFTQKSLSLSPG | DFVMTQSPSSLTVTAGE KVTMSCKSSQSLLNSGN QKNYLTWYLQKPGQPPK LLIYWASTRESGVPDRF TGSGSGTDFTLTISSVQ AEDLAVYYCQNDYSYPY TFGGGTKLEIKRTVAAP SVFIFPPSDEQLKSGTA SVVCLLNNFYPREAKVQ WKVDNALQSGNSQESVT EQDSKDSTYSLSSTLTL SKADYEKHKVYACEVTH QGLSSPVTKSFNRGEC |

TABLE 3-continued

Sequences of bispecific T cell engager antibodies

| ID | LC1 Sequence | HC1 Sequence | HC2 Sequence | LC2 Sequence |
|---|---|---|---|---|
| 45 anti-CD3ε x anti-TNP Negative control Wild Type SEQ ID NO: 95 | DIQLTQSPAIMSASPG EKVTMTCRASSSVSYM NWYQQKSGTSPKRWIY DTSKVASGVPYRFSGS GSGTSYSLTISSMEAE DAATYYCQQWSSNPLT FGAGTKLELKRTVAAP SVFIFPPSDEQLKSGT ASVVCLLNNFYPREAK VQWKVDNALQSGNSQE SVTEQDSKDSTYSLSS TLTLSKADYEKHKVYA CEVTHQGLSSPVTKSF NRGEC | DIKLQQSGAELARPGASV KMSCKTSGYTFTRYTMHW VKQRPGQGLEWIGYINPS RGYTNYNQKFKDKATLTT DKSSSTAYMQLSSLTSED SAVYYCARYYDDHYCLDY WGQGTTLTVSSASTKGPS VFPLAPSSKSTSGGTAAL GCLVKDYFPEPVTVSWNS GALTSGVHTFPAVLQSSG LYSLSSVVTVPSSSLGTQ TYICNVNHKPSNTKVDKK VEPKSCDKTHTCPPCPAP EAAGGPSVFLFPPKPKDT LMISRTPEVTCVVVDVSH EDPEVKFNWYVDGVEVHN AKTKPREEQYNSTYRVVS VLTVLHQDWLNGKEYKCK VSNKALPAPIEKTISKAK GQPREPQVYTLPPCRDEL TKNQVSLWCLVKGFYPSD IAVEWESNGQPENNYKTT PPVLDSDGSFFLYSKLTV DKSRWQQGNVFSCSVMHE ALHNHYTQKSLSLSPG | QIQLVQSGSELKKPGASVK VSCKASGYTFTNYGMNWVR QAPGQGLEWVGWINTYTGG PKYAQGFTGRFVFSVDTSV STAYLQISSLKAEDTAVYY CARGIYDGYHWYFDVWGRG TLVTVSSASTKGPSVFPLA PSSKSTSGGTAALGCLVKD YFPEPVTVSWNSGALTSGV HTFPAVLQSSGLYSLSSVV TVPSSSLGTQTYICNVNHK PSNTKVDKKVEPKSCDKTH TCPPCPAPEAAGGPSVFLF PPKPKDTLMISRTPEVTCV VVDVSHEDPEVKFNWYVDG VEVHNAKTKPREEQYNSTY RVVSVLTVLHQDWLNGKEY KCKVSNKALPAPIEKTISK AKGQPREPQVCTLPPSRDE LTKNQVSLSCAVKGFYPSD IAVEWESNGQPENNYKTTP PVLDSDGSFFLVSKLTVDK SRWQQGNVFSCSVMHEALH NRFTQKSLSLSPG | DVVMTQSPLSLPVTLGQ PASISCRSSQSLVHSIG NTYLHWYQQRPGQSPRL LIYKVSNRFSGVPDRFS GSGSGTDFTLKISRVEA EDVGVYYCSQSTHVPFT FGQGTKLEIKRTVAAPS VFIFPPSDEQLKSGTAS VVCLLNNFYPREAKVQW KVDNALQSGNSQESVTE QDSKDSTYSLSSTLTLS KADYEKHKVYACEVTHQ GLSSPVTKSFNRGEC |
| 46 anti-CD3ε x anti-TNP-dsTrasK02 Negative control SEQ ID NO: 96 | DIQLTQSPAIMSASPG EKVTMTCRASSSVSYM NWYQQKSGTSPKRWIY DTSKVASGVPYRFSGS GSGTSYSLTISSMEAE DAATYYCQQWSSNPLT FGAGTKLELKRTVAAP SVFIFPPSDEQLKSGT ASVVCLLNNFYPREAK VQWKVDNALQSGNSQE SVTEQDSKDSTYSLSS TLTLSKADYEKHKVYA CEVTHQGLSSPVTKSF NRGEC | DIKLQQSGAELARPGASV KMSCKTSGYTFTRYTMHW VKQRPGQGLEWIGYINPS RGYTNYNQKFKDKATLTT DKSSSTAYMQLSSLTSED SAVYYCARYYDDHYCLDY WGQGTTLTVSSASTKGPS VFPLAPSSKSTSGGTAAL GCLVKDYFPEPVTVSWNS GALTSGVHTFPAVLQSSG LYSLSSVVTVPSSSLGTQ TYICNVNHKPSNTKVDKK VEPKSCDKTHTCPPCPAP EAAGGPSVFLFPPKPKDT LMISRTPEVTCVVVDVSH EDPEVKFNWYVDGVEVHN AKTKPREEQYNSTYRVVS VLTVLHQDWLNGKEYKCK VSNKALPAPIEKTISKAK GQPREPQVYTLPPCRDEL TKNQVSLWCLVKGFYPSD IAVEWESNGQPENNYKTT PPVLDSDGSFFLYSKLTV DKSRWQQGNVFSCSVMHE ALHNHYTQKSLSLSPG | QIQLVQSGSELKKPGASVK VSCKASGYTFTNYGMNWVR QAPGQGLEWVGWINTYTGG PKYAQGFTGRFVFSVDTSV STAYLQISSLKAEDTAVYY CARGIYDGYHWYFDVWGRG TLVTVSSGGGGSGGGGSEV QLVESGGGLVQPGGSLRLS CAASGFNIKDTYIHWVRQA PGKCLEVWAEIYPTNGYTE YADSVKGRFTISADTSKNT AYLQMNSLRAEDTAVYYCS RWGGDGFYAMDYWGQGTLV TVSSDKTHTCPPCPAPEAA GGPSVFLFPPKPKDTLMIS RTPEVTCVVVDVSHEDPEV KFNWYVDGVEVHNAKTKPR EEQYNSTYRVVSVLTVLHQ DWLNGKEYKCKVSNKALPA PIEKTISKAKGQPREPQVC TLPPSRDELTKNQVSLSCA VKGFYPSDIAVEWESNGQP ENNYKTTPPVLDSDGSFFL VSKLTVDKSRWQQGNVFSC SVMHEALHNRFTQKSLSLS PG | DVVMTQSPLSLPVTLGQ PASISCRSSQSLVHSIG NTYLHWYQQRPGQSPRL LIYKVSNRFSGVPDRFS GSGSGTDFTLKISRVEA EDVGVYYCSQSTHVPFT FGGGTKLEIKGGGGSGG GGSDIQMTQSPSSLSAS VGDRVTITCRASQDVNT AVAWYQQKPGKAPKLLI YSASFLYSGVPSRFSGS RSGTDFTLTISSLQPED FATYYCQQHYTTPPTFG CGTKVEIK |
| 47 anti-CD3ε-dsTrasK02 x anti-TNP Negative control SEQ ID NO: 97 | DIQLTQSPAIMSASPG EKVTMTCRASSSVSYM NWYQQKSGTSPKRWIY DTSKVASGVPYRFSGS GSGTSYSLTISSMEAE DAATYYCQQWSSNPLT FGAGTKLELKGGGGSG GGGSDIQMTQSPSSLS ASVGDRVTITCRASQD VNVTITCRASQDTAVA WYQQKPGKAPKLLIYS ASFLYSGVPSRFSGSR SGTDFTLTISSLQPED FATYYCQQHYTTPPTF GCGTKVEIK | DIKLQQSGAELARPGASV KMSCKTSGYTFTRYTMHW VKQRPGQGLEWIGYINPS RGYTNYNQKFKDKATLTT DKSSSTAYMQLSSLTSED SAVYYCARYYDDHYCLDY WGQGTTLTVSSGGGGSGG GGSEVQLVESGGGLVQPG GSLRLSCAASGFNIKDTY IHWVRQAPGKCLEWVAEI YPTNGYTEYADSVKGRFT ISADTSKNTAYLQMNSLR AEDTAVYYCSRWGGDGFY AMDYWGQGTLVTVSSDKT HTCPPCPAPEAAGGPSVF LFPPKPKDTLMISRTPEV TCVVVDVSHEDPEVKFNW YVDGVEVHNAKTKPREEQ YNSTYRVVSVLTVLHQDW LNGKEYKCKVSNKALPAP IEKTISKAKGQPREPQVY | QIQLVQSGSELKKPGASVK VSCKASGYTFTNYGMNWVR QAPGQGLEWVGWINTYTGG PKYAQGFTGRFVFSVDTSV STAYLQISSLKAEDTAVYY CARGIYDGYHWYFDVWGRG TLVTVSSASTKGPSVFPLA PSSKSTSGGTAALGCLVKD YFPEPVTVSWNSGALTSGV HTFPAVLQSSGLYSLSSVV TVPSSSLGTQTYICNVNHK PSNTKVDKKVEPKSCDKTH TCPPCPAPEAAGGPSVFLF PPKPKDTLMISRTPEVTCV VVDVSHEDPEVKFNWYVDG VEVHNAKTKPREEQYNSTY RVVSVLTVLHQDWLNGKEY KCKVSNKALPAPIEKTISK AKGQPREPQVCTLPPSRDE LTKNQVSLSCAVKGFYPSD IAVEWESNGQPENNYKTTP | DVVMTQSPLSLPVTLGQ PASISCRSSQSLVHSIG NTYLHWYQQRPGQSPRL LIYKVSNRFSGVPDRFS GSGSGTDFTLKISRVEA EDVGVYYCSQSTHVPFT FGQGTKLEIKRTVAAPS VFIFPPSDEQLKSGTAS VVCLLNNFYPREAKVQW KVDNALQSGNSQESVTE QDSKDSTYSLSSTLTLS KADYEKHKVYACEVTHQ GLSSPVTKSFNRGEC |

TABLE 3-continued

Sequences of bispecific T cell engager antibodies

| ID | LC1 Sequence | HC1 Sequence | HC2 Sequence | LC2 Sequence |
|---|---|---|---|---|
| | | TLPPCRDELTKNQVSLWC LVKGFYPSDIAVEWESNG QPENNYKTTPPVLDSDGS FFLYSKLTVDKSRWQQGN VFSCSVMHEALHNYTQK SLSLSPG | PVLDSDGSFFLVSKLTVDK SRWQQGNVFSCSVMHEALH NRFTQKSLSLSPG | |
| 48 anti-CD3ε x anti-TNP Negative control Wild Type SEQ ID NO: 98 | DIVMTQTPLSLSVTPG QPASISCKSSQSLVHE NLQTYLSWYLQKPGQS PQSLIYKVSNRFSGVP DRFSGSGSGTDFTLKI SRVEAEDVGVYYCGQG TQYPFTFGSGTKVEIK RTVAAPSVFIFPPSDE QLKSGTASVVCLLNNF YPREAKVQWKVDNALQ SGNSQESVTEQDSKDS TYSLSSTLTLSKADYE KHKVYACEVTHQGLSS PVTKSFNRGEC | QVQLVESGGGVVQPGRSL RLSCAASGFTFTKAWMHW VRQAPGKQLEWVAQIKDK SNSYATYYADSVKGRFTI SRDDSKNTLYLQMNSLRA EDTAVYYCRGVYYALSPF DYWGQGTLVTVSSASTKG PSVFPLAPSSKSTSGGTA ALGCLVKDYFPEPVTVSW NSGALTSGVHTFPAVLQS SGLYSLSSVVTVPSSSLG TQTYICNVNHKPSNTKVD KKVEPKSCDKTHTCPPCP APEAAGGPSVFLFPPKPK DTLMISRTPEVTCVVVDV SHEDPEVKFNWYVDGVEV HNAKTKPREEQYNSTYRV VSVLTVLHQDWLNGKEYK CKVSNKALPAPIEKTISK AKGQPREPQVYTLPPCRD ELTKNQVSLWCLVKGFYP SDIAVEWESNGQPENNYK TTPPVLDSDGSFFLYSKL TVDKSRWQQGNVFSCSVM HEALHNHYTQKSLSLSPG | QIQLVQSGSELKKPGASVK VSCKASGYTFTNYGMNWVR QAPGQGLEWVGWINTYTGG PKYAQGFTGRFVFSVDTSV STAYLQISSLKAEDTAVYY CARGIYDGYHWYFDVWGRG TLVTVSSASTKGPSVFPLA PSSKSTSGGTAALGCLVKD YFPEPVTVSWNSGALTSGV HTFPAVLQSSGLYSLSSVV TVPSSSLGTQTYICNVNHK PSNTKVDKKVEPKSCDKTH TCPPCPAPEAAGGPSVFLF PPKPKDTLMISRTPEVTCV VVDVSHEDPEVKFNWYVDG VEVHNAKTKPREEQYNSTY RVVSVLTVLHQDWLNGKEY KCKVSNKALPAPIEKTISK AKGQPREPQVCTLPPSRDE LTKNQVSLSCAVKGFYPSD IAVEWESNGQPENNYKTTP PVLDSDGSFFLVSKLTVDK SRWQQGNVFSCSVMHEALH NRFTQKSLSLSPG | DVVMTQSPLSLPVTLGQ PASISCRSSQSLVHSIG NTYLHWYQQRPGQSPRL LIYKVSNRFSGVPDRFS GSGSGTDFTLKISRVEA EDVGVYYCSQSTHVPFT FGGGTKLEIKRTVAAPS VFIFPPSDEQLKSGTAS VVCLLNNFYPREAKVQW KVDNALQSGNSQESVTE QDSKDSTYSLSSTLTLS KADYEKHKVYACEVTHQ GLSSPVTKSFNRGEC |
| 49 anti-CD3ε x anti-TNP-dsTrasK O2 Negative control SEQ ID NO: 99 | DIVMTQTPLSLSVTPG QPASISCKSSQSLVHE NLQTYLSWYLQKPGQS PQSLIYKVSNRFSGVP DRFSGSGSGTDFTLKI SRVEAEDVGVYYCGQG TQYPFTFGSGTKVEIK RTVAAPSVFIFPPSDE QLKSGTASVVCLLNNF YPREAKVQWKVDNALQ SGNSQESVTEQDSKDS TYSLSSTLTLSKADYE KHKVYACEVTHQGLSS PVTKSFNRGEC | QVQLVESGGGVVQPGRSL RLSCAASGFTFTKAWMHW VRQAPGKQLEWVAQIKDK SNSYATYYADSVKGRFTI SRDDSKNTLYLQMNSLRA EDTAVYYCRGVYYALSPF DYWGQGTLVTVSSASTKG PSVFPLAPSSKSTSGGTA ALGCLVKDYFPEPVTVSW NSGALTSGVHTFPAVLQS SGLYSLSSVVTVPSSSLG TQTYICNVNHKPSNTKVD KKVEPKSCDKTHTCPPCP APEAAGGPSVFLFPPKPK DTLMISRTPEVTCVVVDV SHEDPEVKFNWYVDGVEV HNAKTKPREEQYNSTYRV VSVLTVLHQDWLNGKEYK CKVSNKALPAPIEKTISK AKGQPREPQVYTLPPCRD ELTKNQVSLWCLVKGFYP SDIAVEWESNGQPENNYK TTPPVLDSDGSFFLYSKL TVDKSRWQQGNVFSCSVM HEALHNHYTQKSLSLSPG | QIQLVQSGSELKKPGASVK VSCKASGYTFTNYGMNWVR QAPGQGLEWVGWINTYTGG PKYAQGFTGRFVFSVDTSV STAYLQISSLKAEDTAVYY CARGIYDGYHWYFDVWGRG TLVTVSSGGGGSGGGGSEV QLVESGGGLVQPGGSLRLS CAASGFNIKDTYIHWRQA PGKCLEWVAEIYPTNGYTE YADSVKGRFTISADTSKNT AYLQMNSLRAEDTAVYYCS RWGGDGFYAMDYWGQGTLV TVSSDKTHTCPPCPAPEAA GGPSVFLFPPKPKDTLMIS RTPEVTCVVVDVSHEDPEV KFNWYVDGVEVHNAKTKPR EEQYNSTYRVVSVLTVLHQ DWLNGKEYKCKVSNKALPA PIEKTISKAKGQPREPQVC TLPPSRDELTKNQVSLCA VKGFYPSDIAVEWESNGQP ENNYKTTPPVLDSDGSFFL VSKLTVDKSRWQQGNVFSC SVMHEALHNRFTQKSLSLS PG | DVVMTQSPLSLPVTLGQ PASISCRSSQSLVHSIG NTYLHWYQQRPGQSPRL LIYKVSNRFSGVPDRFS GSGSGTDFTLKISRVEA EDVGVYYCSQSTHVPFT FGQGTKLEIKGGGGSGG GGSGGGGSDIQMTQSPSSLSAS VGDRVTITCRASQDVNT AVAWYQQKPGKAPKLLI YSASFLYSGVPSRFSGS RSGTDFTLTISSLQPED FATYYCQQHYTTPPTFG CGTKVEIK |
| 50 anti-CD3-dsTrasK O2 x anti-TNP Negative control SEQ ID NO: 100 | DIVMTQTPLSLSVTPG QPASISCKSSQSLVHE NLQTYLSWYLQKPGQS PQSLIYKVSNRFSGVP DRFSGSGSGTDFTLKI SRVEAEDVGVYYCGQG TQYPFTFGSGTKVEIK GGGGSGGGGSDIQMTQ SPSSLSASVGDRVTIT CRASQDVNTAVAWYQQ KPGKAPKLLIYSASFL YSGVPSRFSGSRSGTD FTLTISSLQPEDFATY YCQQHYTTPPTFGCGT KVEIK | QVQLVESGGGVVQPGRSL RLSCAASGFTGTKAWMHW VRQAPGKQLEWVAQIKDK SNSYATYYADSVKGRFTI SRDDSKNTLYLQMNSLRA EDTAVYYCRGVYYALSPF DYWGQGTLVTVSSGGGGS GGGGSEVQLVESGGGLVQ PGGSLRLSCAASGFNIKD TYIHWRQAPGKCLEWVA EIYPTNGYTEYADSVKGR FTISADTSKNTAYLQMNS LRAEDTAVYYCSRWGGDG FYAMDWGQGTLVTVSSD KTHTCPPCPAPEAAGGPS | QIQLVQSGSELKKPGASVK VSCKASGYTFTNYGMNWVR QAPGQGLEWVGWINTYTGG PKYAQGFTGRFVFSVDTSV STAYLQISSLKAEDTAVYY CARGIYDGYHWYFDVWGRG TLVTVSSASTKGPSVFPLA PSSKSTSGGTAALGCLVKD YFPEPVTVSWNSGALTSGV HTFPAVLQSSGLYSLSSVV TVPSSSLGTQTYICNVNHK PSNTKVDKKVEPKSCDKTH TCPPCPAPEAAGGPSVFLF PPKPKDTLMISRTPEVTCV VVDVSHEDPEVKFNWYVDG | DVVMTQSPLSLPVTLGQ PASISCRSSQSLVHSIG NTYLHWYQQRPGQSPRL LIYKVSNRFSGVPDRFS GSGSGTDFTLKISRVEA EDVGVYYCSQSTHVPFT FGGGTKLEIKRTVAAPS VFIFPPSDEQLKSGTAS VVCLLNNFYPREAKVQW KVDNALQSGNSQESVTE QDSKDSTYSLSSTLTLS KADYEKHKVYACEVTHQ GLSSPVTKSFNRGEC |

TABLE 3-continued

Sequences of bispecific T cell engager antibodies

| ID | LC1 Sequence | HC1 Sequence | HC2 Sequence | LC2 Sequence |
|---|---|---|---|---|
| | | VFLFPPKPKDTLMISRTP EVTCVVVDVSHEDPEVKF NWYVDGVEVHNAKTKPRE EQYNSTYRVVSVLTVLHQ DWLNGKEYKCKVSNKALP APIEKTISKAKGQPREPQ VYTLPPCRDELTKNQVSL WCLVKGFYPSDIAVEWES NGQPENNYKTTPPVLDSD GSFFLYSKLTVDKSRWQQ GNVFSCSVMHEALHNHYT QKSLSLSPG | VEVHNAKTKPREEQYNSTY RVVSVLTVLHQDWLNGKEY KCKVSNKALPAPIEKTISK AKGQPREPQVCTLPPSRDE LTKNQVSLSCAVKGFYPSD IAVEWESNGQPENNYKTTP PVLDSDGSFFLVSKLTVDK SRWQQGNVFSCSVMHEALH NRFTQKSLSLSPG | |

(e) Nucleic Acids

In a fifth aspect, the present invention relates to an isolated nucleic acid molecule comprising a nucleotide sequence encoding the pseudoFab containing one or both of a binding protein and a multispecific binding protein of either the first, second or third aspect of the present invention.

One aspect of the present invention relates to a polynucleotide encoding a binding protein of any one of the first to third aspects of the present invention.

Standard recombinant DNA methodologies are used to construct the polynucleotides that encode the polypeptides which form the binding proteins, incorporate these polynucleotides into recombinant expression vectors, and introduce such vectors into host cells. See e.g., Sambrook et al., 2001, MOLECULAR CLONING: A LABORATORY MANUAL (Cold Spring Harbor Laboratory Press, 3rd ed.). Enzymatic reactions and purification techniques may be performed according to manufacturer's specifications, as commonly accomplished in the art, or as described herein. Unless specific definitions are provided, the nomenclature utilized in connection with, and the laboratory procedures and techniques of, analytical chemistry, synthetic organic chemistry, and medicinal and pharmaceutical chemistry described herein are those well-known and commonly used in the art. Similarly, conventional techniques may be used for chemical syntheses, chemical analyses, pharmaceutical preparation, formulation, delivery, and treatment of patients.

Other aspects of the present disclosure relate to isolated nucleic acid molecules comprising a nucleotide sequence encoding any of the binding proteins described herein. In some embodiments of the fifth aspect of the present invention, the isolated nucleic acid molecules comprise a sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to a nucleic acid that encodes any of the binding proteins described herein.

Certain aspects of the present disclosure relate to kits of polynucleotides. In some embodiments, one or more of the polynucleotides is a vector (e.g., an expression vector). The kits may find use, inter alia, in producing one or more of the binding proteins described herein, e.g., a heterodimerization domain, a bivalent, trivalent, tetravalent or multivalent binding protein of the present disclosure.

In some embodiments, the isolated nucleic acid is operably linked to a heterologous promoter to direct transcription of the binding protein-coding nucleic acid sequence. A promoter may refer to nucleic acid control sequences which direct transcription of a nucleic acid. A first nucleic acid sequence is operably linked to a second nucleic acid sequence when the first nucleic acid sequence is placed in a functional relationship with the second nucleic acid sequence. For instance, a promoter is operably linked to a coding sequence of a binding protein if the promoter affects the transcription or expression of the coding sequence. Examples of promoters may include, but are not limited to, promoters obtained from the genomes of viruses (such as polyoma virus, fowlpox virus, adenovirus (such as Adenovirus 2), bovine papilloma virus, avian sarcoma virus, cytomegalovirus, a retrovirus, hepatitis-B virus, Simian Virus 40 (SV40), and the like), from heterologous eukaryotic promoters (such as the actin promoter, an immunoglobulin promoter, from heat-shock promoters, and the like), the CAG-promoter (Niwa et al., Gene 108(2):193-9, 1991), the phosphoglycerate kinase (PGK)-promoter, a tetracycline-inducible promoter (Masui et al., Nucleic Acids Res. 33:e43, 2005), the lac system, the trp system, the tac system, the trc system, major operator and promoter regions of phage lambda, the promoter for 3-phosphoglycerate kinase, the promoters of yeast acid phosphatase, and the promoter of the yeast alpha-mating factors. Polynucleotides encoding binding proteins of the present disclosure may be under the control of a constitutive promoter, an inducible promoter, or any other suitable promoter described herein or other suitable promoter that will be readily recognized by one skilled in the art.

In some embodiments, the isolated nucleic acid is incorporated into a vector. In some embodiments, the vector is an expression vector. Expression vectors may include one or more regulatory sequences operatively linked to the polynucleotide to be expressed. The term "regulatory sequence," as used herein, includes promoters, enhancers and other expression control elements (e.g., polyadenylation signals). Examples of suitable enhancers may include, but are not limited to, enhancer sequences from mammalian genes (such as globin, elastase, albumin, α-fetoprotein, insulin and the like), and enhancer sequences from a eukaryotic cell virus (such as SV40 enhancer on the late side of the replication origin (bp 100-270), the cytomegalovirus early promoter enhancer, the polyoma enhancer on the late side of the replication origin, adenovirus enhancers, and the like). Examples of suitable vectors may include, for example, plasmids, cosmids, episomes, transposons, and viral vectors (e.g., adenoviral, vaccinia viral, Sindbis-viral, measles, herpes viral, lentiviral, retroviral, adeno-associated viral vectors, etc.). Expression vectors can be used to transfect host cells, such as, for example, bacterial cells, yeast cells, insect cells, and mammalian cells. Biologically functional viral and plasmid DNA vectors capable of expression and replication in a host are known in the art, and can be used to transfect any cell of interest.

In a sixth aspect, the present invention relates to an expression vector comprising the nucleic acid molecule of the fifth aspect of the present invention.

Other aspects of the present disclosure relate to a vector system comprising one or more vectors encoding a first, second, third, and fourth polypeptide chain of any of the binding proteins described herein. In some embodiments of the sixth aspect of the present invention, the vector system comprises a first vector encoding the first polypeptide chain of the binding protein, a second vector encoding the second polypeptide chain of the binding protein, a third vector encoding the third polypeptide chain of the binding protein, and a fourth vector encoding the fourth polypeptide chain of the binding protein. In some embodiments, the vector system comprises a first vector encoding the first and second polypeptide chains of the binding protein, and a second vector encoding the third and fourth polypeptide chains of the binding protein. In some embodiments, the vector system comprises a first vector encoding the first and third polypeptide chains of the binding protein, and a second vector encoding the second and fourth polypeptide chains of the binding protein. In some embodiments, the vector system comprises a first vector encoding the first and fourth polypeptide chains of the binding protein, and a second vector encoding the second and third polypeptide chains of the binding protein. In some embodiments, the vector system comprises a first vector encoding the first, second, third, and fourth polypeptide chains of the binding protein. The one or more vectors of the vector system may be any of the vectors described herein. In some embodiments, the one or more vectors are expression vectors.

(f) Isolated Host Cells

In a seventh aspect, the present invention relates to an isolated host cell comprising the nucleic acid molecule of the fifth aspect of the present invention or the expression vector of the sixth aspect of the present invention.

Other aspects of the present disclosure relate to an isolated host cell comprising one or more isolated polynucleotides, polynucleotide kits, vectors, and/or vector systems described herein. In some embodiments of the seventh aspect of the present invention, the host cell is a bacterial cell (e.g., an *E. coli* cell). In some embodiments, the host cell is an *E. coli* DH5a cell. In some embodiments, the host cell is a yeast cell (e.g., an *S. cerevisiae* cell). In some embodiments, the host cell is an insect cell. Examples of insect host cells may include, for example, *Drosophila* cells (e.g., S2 cells), *Trichoplusia ni* cells (e.g., High Five™ cells), and *Spodoptera frugiperda* cells (e.g., Sf21 or Sf9 cells). In some embodiments, the host cell is a mammalian cell. Examples of mammalian host cells may include, for example, human embryonic kidney cells (e.g., 293 or 293 cells sub-cloned for growth in suspension culture), Expi293™ cells, CHO cells, baby hamster kidney cells (e.g., BHK, ATCC CCL 10), mouse sertoli cells (e.g., TM4 cells), monkey kidney cells (e.g., CV1 ATCC CCL 70), African green monkey kidney cells (e.g., VERO-76, ATCC CRL-1587), human cervical carcinoma cells (e.g., HELA, ATCC CCL 2), canine kidney cells (e.g., MDCK, ATCC CCL 34), buffalo rat liver cells (e.g., BRL 3A, ATCC CRL 1442), human lung cells (e.g., W138, ATCC CCL 75), human liver cells (e.g., Hep G2, HB 8065), mouse mammary tumor cells (e.g., MMT 060562, ATCC CCL51), TRI cells, MRC 5 cells, FS4 cells, a human hepatoma line (e.g., Hep G2), myeloma cells (e.g., NS0 and Sp2/0 cells) and the like.

IV. Methods of Preparation

1. Expression Methods

Other aspects of the present disclosure relate to a method of producing any of the binding proteins described herein. In some embodiments, the method includes:

a) culturing a host cell (e.g., any of the host cells described herein) comprising an isolated nucleic acid, vector, and/or vector system (e.g., any of the isolated nucleic acids, vectors, and/or vector systems described herein) under conditions such that the host cell expresses the binding protein; and b) isolating the binding protein from the host cell. Methods of culturing host cells under conditions to express a protein are well known to one of ordinary skill in the art. Methods of isolating proteins from cultured host cells are well known to one of ordinary skill in the art, including, for example, by affinity chromatography (e.g., two step affinity chromatography comprising protein A affinity chromatography followed by size exclusion chromatography).

2. Purification Methods

In a fourth aspect the present invention relates to a method for purifying a multispecific binding protein of the third aspect of the invention comprising the steps of:

(i) applying a solution comprising the multispecific binding protein to a first, second, or third affinity reagent, that specifically binds to a recognition site of the multispecific binding protein for the first, second or third affinity reagent; and (ii) recovering either the multispecific binding protein that does not bind to the first, second or third affinity reagent or the multispecific binding protein that binds to the first, or third affinity reagent, wherein each of the first, second and third affinity reagent binds to a different recognition site of the multispecific binding protein.

In some embodiments, the method comprising the further steps of applying a solution comprising the multispecific binding protein recovered in step (ii) to the first, second or third affinity reagent, wherein the affinity reagent is different from the affinity reagent used in step (i), recovering either the multispecific binding protein that does not bind to the first, second, or third affinity reagent or the multispecific binding protein that binds to the first, or third affinity reagent.

In some embodiments the first affinity reagent is binding to OK; the second affinity reagent is protein A; and/or the third affinity reagent is Protein G.

In some embodiments, a binding protein of the present disclosure is purified by protein A affinity chromatography, kappa light chain affinity chromatography (e.g., using a KappaSelect resin according to manufacturer's instructions; GE Healthcare), and optionally lambda light chain affinity chromatography (e.g., using a LambdaFabSelect resin according to manufacturer's instructions; GE Healthcare). In some embodiments, a binding protein of the present disclosure is purified by Protein A affinity chromatography, lambda light chain affinity chromatography (e.g., using a LambdaFabSelect resin according to manufacturer's instructions; GE Healthcare), and optionally kappa light chain affinity chromatography (e.g., using a KappaSelect resin according to manufacturer's instructions; GE Healthcare). In some embodiments, the binding protein comprises two Fc regions, each comprising a CH3 domain, and only one of the CH3 domains comprises amino acid substitutions at positions corresponding to positions 435 and 436 of human IgG1 or IgG4 according to EU Index, wherein the amino acid substitutions are H435R and Y436F. In some embodiments, a binding protein of the present disclosure is purified by protein A affinity chromatography, then kappa light chain affinity chromatography (e.g., using a KappaSelect resin according to manufacturer's instructions; GE Healthcare), then optionally lambda light chain affinity chromatography (e.g., using a LambdaFabSelect resin according to manufacturer's instructions; GE Healthcare) in sequence. In some embodiments, a binding protein of the present disclosure is purified by protein A affinity chromatography, then lambda light chain affinity chromatography (e.g., using a LambdaFabSelect resin according to manufacturer's instructions; GE Healthcare), then optionally kappa light chain affinity chromatography (e.g., using a KappaSelect resin according to manufacturer's instructions; GE Healthcare) in sequence. For example, in some embodiments, the binding protein is contacted with Protein A, eluted from Protein A under conditions suitable for isolating the binding protein away from binding proteins comprising either 0 or 2 CH3 domains comprising the amino acid substitutions are H435R and Y436F, contacted with a kappa light chain affinity medium (e.g., as used in the KappaSelect resin; GE Healthcare), and eluted from the kappa light chain affinity medium under conditions suitable for isolating the binding protein away from binding proteins comprising only lambda CL domains (e.g., according to manufacturer's instructions).

Conditions suitable for the Protein A elution are known in the art, including without limitation a stepwise elution gradient from pH4.5-2.8. In some embodiments, Protein A or a Protein A variant useful for protein purification is employed. In some embodiments, the Protein A is attached to a substrate or resin, e.g., as part of a chromatography medium. In some embodiments, after elution from the kappa light chain affinity medium, the binding protein is contacted with a lambda light chain affinity medium (e.g., as used in the LambdaFabSelect resin; GE Healthcare), and eluted from the lambda light chain affinity medium under conditions suitable for isolating the binding protein away from binding proteins comprising only kappa CL domains (e.g., according to manufacturer's instructions). In some embodiments, a binding protein of the present disclosure is detected using HIC chromatography. In some embodiments, the binding protein comprises: a first polypeptide chain that comprises a lambda CL domain; a CH3 domain of a second polypeptide chain that comprises amino acid substitutions at positions corresponding to positions 354 and 366 of human IgG1 or IgG4 according to EU Index, wherein the amino acid substitutions are S354C and T366W; a CH3 domain of a third polypeptide chain that comprises amino acid substitutions at positions corresponding to positions 349, 366, 368, 407, 435, and 436 of human IgG1 or IgG4 according to EU Index, wherein the amino acid substitutions are Y349C, T366S, L368A, Y407V, H435R, and Y436F; and a fourth polypeptide chain that comprises a kappa CL domain. In some embodiments, the binding protein is produced by a host cell. In some embodiments, the binding protein is purified from a cell culture medium or host cell extract. In some embodiments, the binding proteins are secreted by a host cell or produced and extracted from a host cell (e.g., before being contacted with Protein A). In some embodiments, the binding protein is in a cell culture medium or host cell extract when contacted with Protein A. In some embodiments, the binding protein is purified away from other binding proteins, polypeptides, and/or other cellular components.

In some embodiments, a stabilized knockout domain is used to facilitate the preferential synthesis or purification of a desired multispecific binding protein, wherein the stabilized knockout domain comprises (1) one or more inactivating mutations which abolish binding to the target antigen; and (2) one or more engineered interchain disulfide bonds which confer enhanced thermal stability (Tm) relative to the reference Fab molecule, wherein the reference Fab molecule is identical to the pseudoFab molecule except that, in a pseudoFab molecule, CH1 and CL domains of the reference Fab molecule are replaced with VHX and VLX domains.

V. Formulation/Pharmaceutical Composition

In an eighth aspect, the present invention relates to a pharmaceutical composition comprising a pharmaceutically acceptable carrier and a therapeutically effective amount of the protein of any one of first to third aspects of the present invention.

Therapeutic or pharmaceutical compositions comprising binding proteins are within the scope of the disclosure. Some embodiments of the eighth aspect of the present invention comprise pharmaceutical compositions comprising a therapeutically effective amount of any one of the binding proteins as described herein, or a binding protein-drug conjugate, in admixture with a pharmaceutically or physiologically acceptable formulation agent selected for suitability with the mode of administration.

Acceptable formulation materials are typically nontoxic to recipients at the dosages and concentrations employed.

In some embodiments the pharmaceutical composition can contain formulation materials for modifying, maintaining, or preserving, for example, the pH, osmolarity, viscosity, clarity, color, isotonicity, odor, sterility, stability, rate of dissolution or release, adsorption, or penetration of the composition. Suitable formulation materials include, but are not limited to, amino acids (such as glycine, glutamine, asparagine, arginine, or lysine), antimicrobials, antioxidants (such as ascorbic acid, sodium sulfite, or sodium hydrogensulfite), buffers (such as borate, bicarbonate, Tris-HCl, citrates, phosphates, or other organic acids), bulking agents (such as mannitol or glycine), chelating agents (such as ethylenediamine tetraacetic acid (EDTA)), complexing agents (such as caffeine, polyvinylpyrrolidone, beta-cyclodextrin, or hydroxypropyl-beta-cyclodextrin), fillers, monosaccharides, disaccharides, and other carbohydrates (such as glucose, mannose, or dextrins), proteins (such as serum albumin, gelatin, or immunoglobulins), coloring, flavoring and diluting agents, emulsifying agents, hydrophilic polymers (such as polyvinylpyrrolidone), low molecular weight polypeptides, salt-forming counterions (such as sodium), preservatives (such as benzalkonium chloride, benzoic acid, salicylic acid, thimerosal, phenethyl alcohol, methylparaben, propylparaben, chlorhexidine, sorbic acid, or hydrogen peroxide), solvents (such as glycerin, propylene glycol, or polyethylene glycol), sugar alcohols (such as mannitol or sorbitol), suspending agents, surfactants or wetting agents (such as pluronics; PEG; sorbitan esters; polysorbates such as polysorbate 20 or polysorbate 80; triton; tromethamine; lecithin; cholesterol or tyloxapal), stability enhancing agents (such as sucrose or sorbitol), tonicity enhancing agents (such as alkali metal halides, e.g., sodium or potassium chloride, or mannitol sorbitol), delivery vehicles, diluents, excipients and/or pharmaceutical adjuvants (see, e.g., REMINGTON'S PHARMACEUTICAL SCIENCES (18th Ed., A. R. Gennaro, ed., Mack Publishing Company 1990), and subsequent editions of the same, incorporated herein by reference for any purpose).

In some embodiments the optimal pharmaceutical composition will be determined by a skilled artisan depending upon, for example, the intended route of administration, delivery format, and desired dosage. Such compositions can influence the physical state, stability, rate of in vivo release, and rate of in vivo clearance of the binding protein.

In some embodiments the primary vehicle or carrier in a pharmaceutical composition can be either aqueous or non-aqueous in nature. For example, a suitable vehicle or carrier for injection can be water, physiological saline solution, or artificial cerebrospinal fluid, possibly supplemented with other materials common in compositions for parenteral administration. Neutral buffered saline or saline mixed with serum albumin are further exemplary vehicles. Other exemplary pharmaceutical compositions comprise Tris buffer of about pH 7.0-8.5, or acetate buffer of about pH 4.0-5.5, which can further include sorbitol or a suitable substitute. In one embodiment of the disclosure, binding protein compositions can be prepared for storage by mixing the selected composition having the desired degree of purity with optional formulation agents in the form of a lyophilized cake or an aqueous solution. Further, the binding protein can be formulated as a lyophilizate using appropriate excipients such as sucrose.

In some embodiments, the pharmaceutical compositions of the disclosure can be selected for parenteral delivery or subcutaneous. Alternatively, the compositions can be selected for inhalation or for delivery through the digestive tract, such as orally. The preparation of such pharmaceutically acceptable compositions is within the skill of the art.

In some embodiments, the formulation components are present in concentrations that are acceptable to the site of administration. For example, buffers are used to maintain the composition at physiological pH or at a slightly lower pH, typically within a pH range of from about 5 to about 8.

When parenteral administration is contemplated, the therapeutic compositions for use can be in the form of a pyrogen-free, parenterally acceptable, aqueous solution comprising the desired binding protein in a pharmaceutically acceptable vehicle. A particularly suitable vehicle for parenteral injection is sterile distilled water in which a binding protein is formulated as a sterile, isotonic solution, properly preserved. Yet another preparation can involve the formulation of the desired molecule with an agent, such as injectable microspheres, bio-erodible particles, polymeric compounds (such as polylactic acid or polyglycolic acid), beads, or liposomes, that provides for the controlled or sustained release of the product which can then be delivered via a depot injection. Hyaluronic acid can also be used, and this can have the effect of promoting sustained duration in the circulation. Other suitable means for the introduction of the desired molecule include implantable drug delivery devices.

In one embodiment, a pharmaceutical composition can be formulated for inhalation. For example, a binding protein can be formulated as a dry powder for inhalation. Binding protein inhalation solutions can also be formulated with a propellant for aerosol delivery. In yet another embodiment, solutions can be nebulized.

It is also contemplated that certain formulations can be administered orally. In one embodiment of the disclosure, multispecific binding proteins that are administered in this fashion can be formulated with or without those carriers customarily used in the compounding of solid dosage forms such as tablets and capsules. For example, a capsule can be designed to release the active portion of the formulation at the point in the gastrointestinal tract when bioavailability is maximized and pre-systemic degradation is minimized. Additional agents can be included to facilitate absorption of the binding protein. Diluents, flavorings, low melting point waxes, vegetable oils, lubricants, suspending agents, tablet disintegrating agents, and binders can also be employed.

Another pharmaceutical composition can involve an effective quantity of multispecific binding proteins in a mixture with non-toxic excipients that are suitable for the manufacture of tablets. By dissolving the tablets in sterile water, or another appropriate vehicle, solutions can be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions of the disclosure will be evident to those skilled in the art, including formulations involving binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. Additional examples of sustained-release preparations include semipermeable polymer matrices in the form of shaped articles, e.g., films, or microcapsules. Sustained release matrices can include polyesters, hydrogels, polylactides, copolymers of L-glutamic acid and gamma ethyl-L-glutamate, poly(2-hydroxyethyl-methacrylate), ethylene vinyl acetate, or poly-D(−)-3-hydroxybutyric acid. Sustained-release compositions can also include liposomes, which can be prepared by any of several methods known in the art.

In some embodiments pharmaceutical compositions are to be used for in vivo administration typically must be sterile. This can be accomplished by filtration through sterile filtration membranes. Where the composition is lyophilized, sterilization using this method can be conducted either prior to, or following, lyophilization and reconstitution. The composition for parenteral administration can be stored in lyophilized form or in a solution. In addition, parenteral compositions generally are placed into a container having a sterile access port, for example, an intravenous solution bag or vial having a stopper that can be pierced by a hypodermic injection needle.

Once the pharmaceutical composition has been formulated, it can be stored in sterile vials as a solution, suspension, gel, emulsion, solid, or as a dehydrated or lyophilized powder. Such formulations can be stored either in a ready-to-use form or in a form (e.g., lyophilized) requiring reconstitution prior to administration.

The disclosure also encompasses kits for producing a single-dose administration unit. The kits can each contain both a first container having a dried multispecific binding protein and a second container having an aqueous formulation. Also included within the scope of this disclosure are kits containing single and multi-chambered pre-filled syringes (e.g., liquid syringes and lyosyringes).

The effective amount of a binding protein pharmaceutical composition to be employed therapeutically will depend, for example, upon the therapeutic context and objectives. One skilled in the art will appreciate that the appropriate dosage levels for treatment will thus vary depending, in part, upon the molecule delivered, the indication for which the binding protein is being used, the route of administration, and the size (body weight, body surface, or organ size) and condition (the age and general health) of the patient. Accordingly, the clinician can titer the dosage and modify the route of administration to obtain the optimal therapeutic effect.

Dosing frequency will depend upon the pharmacokinetic parameters of the binding protein in the formulation being used. Typically, a clinician will administer the composition until a dosage is reached that achieves the desired effect. The composition can therefore be administered as a single dose, as two or more doses (which may or may not contain the same amount of the desired molecule) over time, or as a continuous infusion via an implantation device or catheter. Further refinement of the appropriate dosage is routinely made by those of ordinary skill in the art and is within the ambit of tasks routinely performed by them. Appropriate dosages can be ascertained through use of appropriate dose-response data.

The route of administration of the pharmaceutical composition is in accord with known methods, e.g., orally; through injection by intravenous, intraperitoneal, intracerebral (intraparenchymal), intracerebroventricular, intramuscular, intraocular, intraarterial, intraportal, or intralesional routes; by sustained release systems; or by implantation devices. Where desired, the compositions can be administered by bolus injection or continuously by infusion, or by implantation device.

In some embodiments the composition can also be administered locally via implantation of a membrane, sponge, or other appropriate material onto which the desired molecule has been absorbed or encapsulated. Where an implantation device is used, the device can be implanted into any suitable tissue or organ, and delivery of the desired molecule can be via diffusion, timed-release bolus, or continuous administration.

VI. Methods of Treatment/Use

In a ninth aspect, the present invention relates to a method of treating a disorder in which antigen activity is detrimental, the method comprising administering to a subject in need thereof an effective amount of a binding protein of any one of the first to third aspects of the present invention. In some embodiments, a multispecific binding protein for use as a medicament is provided.

The binding proteins can be employed in any known assay method, such as competitive binding assays, direct and indirect sandwich assays, and immunoprecipitation assays for the detection and quantitation of one or more target antigens. The binding proteins will bind the one or more target antigens with an affinity that is appropriate for the assay method being employed.

For diagnostic applications, in some embodiments, binding proteins can be labeled with a detectable moiety. The detectable moiety can be any one that is capable of producing, either directly or indirectly, a detectable signal. For example, the detectable moiety can be a radioisotope, such as $^3H$, $^{14}C$, $^{32}P$, $^{35}S$, $^{125}I$, $^{99}Tc$, $^{111}In$, or $^{67}Ga$; a fluorescent or chemiluminescent compound, such as fluorescein isothiocyanate, rhodamine, or luciferin; or an enzyme, such as alkaline phosphatase, β-galactosidase, or horseradish peroxidase.

The binding proteins are also useful for in vivo imaging. A binding protein labeled with a detectable moiety can be administered to an animal, e.g., into the bloodstream, and the presence and location of the labeled antibody in the host assayed. The binding protein can be labeled with any moiety that is detectable in an animal, whether by nuclear magnetic resonance, radiology, or other detection means known in the art.

For clinical or research applications, in some embodiments, binding proteins can be conjugated to a cytotoxic agent. A variety of antibodies coupled to cytotoxic agents (i.e., antibody-drug conjugates) have been used to target cytotoxic payloads to specific tumor cells. Cytotoxic agents and linkers that conjugate the agents to an antibody are known in the art; see, e.g., Parslow, A. C. et al. (2016) *Biomedicines* 4:14 and Kalim, M. et al. (2017) *Drug Des. Devel. Ther.* 11:2265-2276.

The disclosure also relates to a kit comprising a binding protein and other reagents useful for detecting target antigen levels in biological samples. Such reagents can include a detectable label, blocking serum, positive and negative control samples, and detection reagents. In some embodiments, the kit comprises a composition comprising any binding protein, polynucleotide, vector, vector system, and/or host cell described herein. In some embodiments, the kit comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing a condition and may have a sterile access port (for example the container may be an intravenous solution bag or a vial having a stopper that can be pierced by a hypodermic injection needle). In some embodiments, the label or package insert indicates that the composition is used for preventing, diagnosing, and/or treating the condition of choice. Alternatively, or additionally, the article of manufacture or kit may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

In some embodiments, a binding protein of the present disclosure is administered to a patient in need thereof for the treatment or prevention of cancer. In some embodiments, the present disclosure relates to a method of preventing and/or treating a proliferative disease or disorder (e.g., cancer). In some embodiments, the method comprises administering to a patient a therapeutically effective amount of at least one of the binding proteins, or pharmaceutical compositions related thereto, described herein. In some embodiments, the patient is a human In some embodiments, the at least one binding protein is administered in combination with one or more anti-cancer therapies (e.g., any anti-cancer therapy known in the art, such as a chemotherapeutic agent or therapy). In some embodiments, the at least one binding protein is administered before the one or more anti-cancer therapies. In some embodiments, the at least one binding protein is administered concurrently with the one or more anti-cancer therapies. In some embodiments, the at least one binding protein is administered after the one or more anti-retroviral therapies.

EXAMPLES

Before the present invention is described in detail below, it is to be understood that this invention is not limited to the particular methodology, protocols and reagents described herein as these may vary. It is also to be understood that the terminology used herein is for the purpose of describing particular embodiments only, and is not intended to limit the scope of the present invention which will be limited only by the appended claims. Unless defined otherwise, all technical and scientific terms used herein have the same meanings as commonly understood by one of ordinary skill in the art. In particular embodiments, the terms used herein are defined as described in "A multilingual glossary of biotechnological terms: (IUPAC Recommendations)," Leuenberger, H. G. W, Nagel, B. and Kolb, H. eds. (1995), Helvetica Chimica Acta, CH-4010 Basel, Switzerland). Unless otherwise defined herein, scientific and technical terms used herein have the meanings that are commonly understood by those of ordinary skill in the art. In the event of any latent ambiguity, definitions provided herein take precedent over any dictionary or extrinsic definition. Unless otherwise required by context, singular terms shall include pluralities and plural terms shall include the singular. The use of "or" means "and/or" unless stated otherwise. The use of the term "including", as well as other forms, such as "includes" and "included", is not limiting. As used herein, unless otherwise stated, the singular forms "a," "an," and "the" include plural reference. Thus, for example, a reference to "a protein" includes a plurality of protein molecules.

Furthermore, the experiments described herein, unless otherwise indicated, use conventional molecular and cellular biological and immunological techniques within the skill of the art. Such techniques are well known to the skilled worker, and are explained fully in the literature. See, e.g., Ausubel, et al., ed., Current Protocols in Molecular Biology, John Wiley & Sons, Inc., NY, N.Y. (1987-2008), including all supplements, Molecular Cloning: A Laboratory Manual (Fourth Edition) by M R Green and J. Sambrook and Harlow et al., Antibodies: A Laboratory Manual, Chapter 14, Cold Spring Harbor Laboratory, Cold Spring Harbor (2013, 2nd edition).

Several documents are cited throughout the text of this specification. Each of the documents cited herein (including all patents, patent applications, scientific publications, manufacturer's specifications, instructions etc.), whether supra or infra, is hereby incorporated by reference in its entirety. Nothing herein is to be construed as an admission that the invention is not entitled to antedate such disclosure by virtue of prior invention.

In the following, the elements of the present invention will be described. These elements are listed with specific embodiments, however, it should be understood that they may be combined in any manner and in any number to create additional embodiments. The variously described examples and preferred/particular embodiments should not be construed to limit the present invention to only the explicitly described embodiments. This description should be understood to support and encompass embodiments which combine the explicitly described embodiments with any number of the disclosed and/or preferred elements. Furthermore, any permutations and combinations of all described elements in this application should be considered disclosed by the description of the present application unless the context indicates otherwise.

Generally, nomenclatures used in connection with cell and tissue culture, molecular biology, immunology, microbiology, genetics and protein and nucleic acid chemistry and hybridization described herein are those well-known and commonly used in the art. The methods and techniques provided herein are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well-known and commonly used in the art. Standard techniques are used for chemical syntheses, chemical analyses, pharmaceutical preparation, formulation, and delivery, and treatment of patients.

Example 1: Identification of a Suitable Replacement Scaffold

The binding proteins disclosed herein comprise a replacement of one CH1/CL pair with a knockout VH/VL domain in various antibody formats (see FIGS. 1, 2, 7, 10-13). In order to identify a suitable replacement scaffold to replace a CH1/CL dimer, the introduction of disulfide bridges into certain VH/VL pairs was investigated. Further, the expressbility and fusion to another VH/VL pair was investigated.

Trastuzumab was determined to be a suitable replacement scaffold to replace a CH1/CL dimer in order to solve the problem of correct light chain pairing.

Example 2: Use of Trastuzumab Variable Domains to Replace CH1/CL

It was determined that cysteine residues at positions VH44 and VL100 were compatible to generate a disulfide bond between VH/VL of trastuzumab (referred to herein as ds-trastuzumab) thereby stabilizing the heterodimer. For determination of its thermal stability, the ds-trastuzumab domains were incubated at a concentration of 1 mg/mL in D-PBS buffer (GIBCO) for 14 days at 40° C. Control samples at the same concentration were kept at −80° C. and 4° C. After completion of the stress test, the samples were analyzed for their aggregate content by analytical size exclusion chromatography (SEC). Analytical SEC was performed using a BioSECcurity instrument (PSS Polymer) with a TSKgel SuperSW3000 column (4.6 mm×300 mm) and TSKgel SuperSW HPLC guard column (Tosoh Bioscience) at 25° C. The analysis was run at a flow rate of 0.25 ml/min using 250 mM NaCl, 100 mM Na-phosphate pH 6.7 with detection at 280 nm and 260 nm. Static light scattering was detected at 436 nm. 5 μl of protein sample (at 1 mg/ml) were applied onto the column. Data evaluation was performed using WinGPC software v8.1 (PSS Polymer). For estimation of the molecular weight the SEC column was calibrated with protein standards in a molecular weight range from 6.5 to 670 kDa.

The ds-trastuzumab scaffold (with the VH44/VL100 cysteine modifications) was found to increase thermostability by 4° C. (see FIG. 3A-C).

Example 3: Investigating the Connection to VH/VL in a Pseudo-IgG Design

Figure 6B:
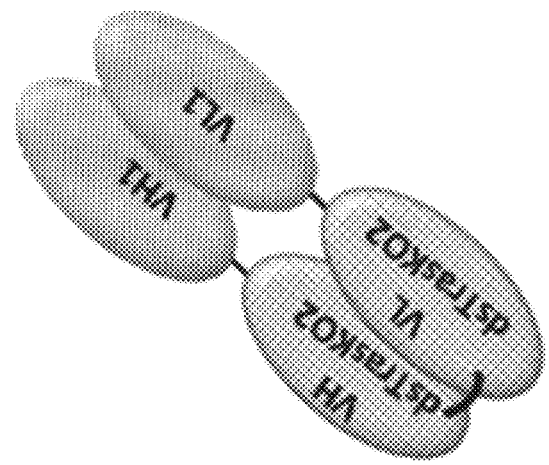
FIG. 6A-FIG. 6B depict the pseudoIgG and and pseudo-Fab constructs used as certain controls in experiments.
Figure 6A:
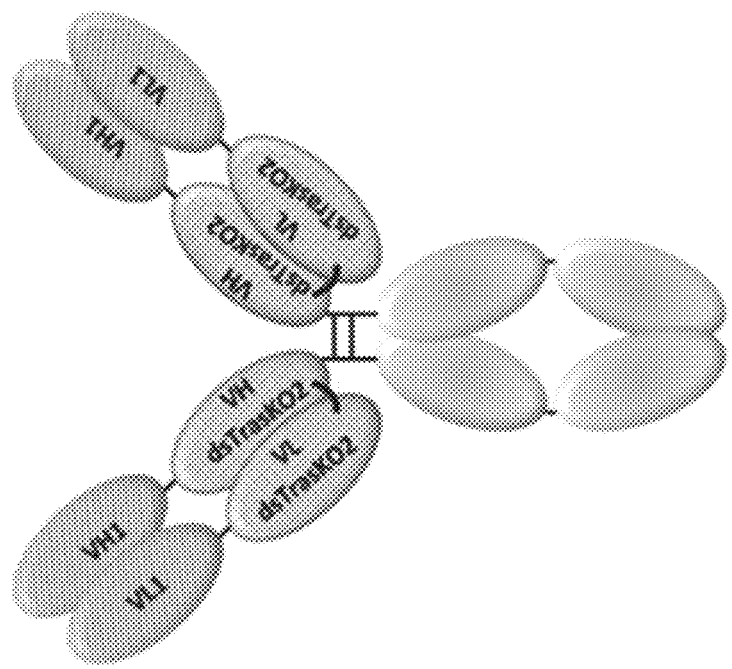

Pseudo-IgG1 constructs containing the disulfide bond stabilized Trastuzumab framework as a replacement scaffold for CH1/CL were generated. The ds-trastuzumab scaffold was fused to a VH/VL pair of interest with G4S or (G4S)2 linker (see FIG. 6).

Determination of Melting Points ($T_m$)

Melting points ($T_m$) were determined using differential scanning fluorimetry (DSF). Samples were diluted in D-PBS buffer (Invitrogen) to a final concentration of 0.2 µg/µl including a 4× concentrated solution of SYPRO-Orange dye (Invitrogen, 5000× stock in DMSO) in D-PBS in white semi-skirt 96-well plates (BIORAD). All measurements were done in duplicate using a MyiQ2 real time PCR instrument (BIORAD). Negative first derivative curves (−d (RFU)/dT) of the melting curves were generated in the iQ5 Software v2.1 (BIORAD). Data were then exported into Excel for Tm determination and graphical display of the data.

Six antibody sequences were expressed in fusion to ds-Trastuzumab and the % monomer following protein A purification and the melting temperature of each fusion protein, as well as the pseudo-IgG antibody without the ds-trastuzumab domain are described in Table 4 below. The expression level was slightly lower compared to that of WT-IgG and the amount of monomer content was slightly lower compared to that of WT-IgG.

TABLE 4

% Monomers and Melting Temperature of Pseudo-IgG1 Antibody-ds-Trastuzumab Fusion Proteins

| ID | Construct | Monomer [%] after Protein A | Melting temp. (° C.) | |
|---|---|---|---|---|
| 1 (SEQ ID NO: 6 and 7) | IL13mAb-G4S-dsTras | 90 | 68 | — |
| 2 (SEQ ID NO: 8 and 9) | IL13mAb-(G4S)2-dsTras | 90 | 67 | — |
| 3 (SEQ ID NO: 10 and 11) | IL13mAb-huIgG1 | 100 | 70 | 80 |
| 4 (SEQ ID NO: 12 and 13) | TNFa mAb-G4S-dsTras | 94 | 61 | 66 |
| 5 (SEQ ID NO: 14 and 15) | TNFa mAb-(G4S)2-dsTras | 93 | 59 | 65 |
| 6 (SEQ ID NO: 16 and 17) | TNFa mAb-huIgG1 | 99 | 71 | — |
| 7 (SEQ ID NO: 18 and 19) | IL6R mAb-G4S-dsTras | 72 | 66 | — |
| 8 (SEQ ID NO: 20 and 21) | IL6R mAb-(G4S)2-dsTras | 96 | 69 | — |
| 9 (SEQ ID NO: 22 and 23) | IL6R mAb-huIgG1 | 98 | 69 | 81 |
| 10 (SEQ ID NO: 24 and 25) | CTLA4mAb-G4S-dsTras | 72 | 67 | — |
| 11 (SEQ ID NO: 26 and 27) | CTLA4mAb-(G4S)2-dsTras | 90 | 67 | — |
| 12 (SEQ ID NO: 28 and 29) | CTLA4mAb-huIgG1 | 99 | 69 | 75 |
| 13 (SEQ ID NO: 30 and 31) | PD1mAb-G4S-dsTras | 80 | 57 | 65 |
| 14 (SEQ ID NO: 32 and 33) | PD1mAb-(G4S)2-dsTras | 76 | 54 | 65 |
| 15 (SEQ ID NO: 34 and 35) | PD1mAb-huIgG1 | 99 | 68 | — |
| 16 (SEQ ID NO: 36 and 37) | IL4mAb-G4S-dsTras | 97 | 70 | — |
| 17 (SEQ ID NO: 38 and 39) | IL4mAb-(G4S)2-dsTras | 96 | 68 | — |
| 18 (SEQ ID NO: 40 and 41) | IL4mAb-huIgG1 | 99 | 70 | 81 |

Example 4: Generation of ds-Tras-knock-out (dsTrasKO) Variants

Binding activity of trastuzumab was knocked-out by the introduction of four key point amino-acid residue mutations in the paratopic region of the Trastuzumab antibody to impact binding capacity of the antibody to Receptor tyrosine-protein kinase erbB-2 (HER2). Trastuzumab was modeled based on PDB structure 1N8Z, available in the PDB public database. Four positions on the heavy chain were identified to potentially destroy the interaction of ds-trastuzumab with its antigen. The positions include both arginine R59 and R50, which bind a glutamate and an aspartate on HER2. Reverting charges by mutating arginine into glutamate residues should result in a repulsion of HER2. Without intending to be bound by scientific theory, the other two positions, tyrosine Y33 & Y105, seemed to stabilize the complex by Pi-Pi interaction with a phenylalanine. Without intending to be bound by scientific theory, mutations in alanine should disrupt this interaction. Crystallographic data from the 1N8Z file were analyzed with BIOVIA Discovery Studio suite. A particular attention was put on the existing interface region between antibody (Trastuzumab fab) and its target (HER2 protein domain) (see FIG. 4).

Analysis of 1N8Z Co-Crystal Interface Region

During the antibody and target interface region analyses, all non-covalent interactions were qualified using BIOVIA Discovery Studio Non-Bond Interaction Monitor. An extract of the resultant table is presented at Table 5. Table 5 presents, for each interaction, the distance between interacting atoms, nature of the interaction type and characteristics of interacting atoms.

TABLE 5

Extract from Non-bond interaction monitor for 1N8Z PDB file. Chains A, B and C correspond respectively to Trastuzumab Fab Light chain, Trastuzumab Fab Heavy chain and HER2.

| Name | Distance | Category | Types | From | From Chemistry | To | To Chemistry |
|---|---|---|---|---|---|---|---|
| B:ARG50:NH1 - C:GLU558:OE1 | 3.13344 | Hydrogen Bond; Electrostatic | Salt Bridge | B:ARG50:NH1 | H-Donor | C:GLU558:OE1 | H-Acceptor |
| B:ARG50:NH2 - C:ASP560:OD2 | 2.60091 | Hydrogen Bond; Electrostatic | Salt Bridge | B:ARG50:NH2 | H-Donor | C:ASP560:OD2 | H-Acceptor |

TABLE 5-continued Extract from Non-bond interaction monitor for 1N8Z PDB file. Chains A, B and C correspond respectively to Trastuzumab Fab Light chain, Trastuzumab Fab Heavy chain and HER2.

| Name | Distance | Category | Types | From | From Chemistry | To | To Chemistry |
|---|---|---|---|---|---|---|---|
| B:ARG59:NH1 - C:ASP560:OD2 | 3.60836 | Hydrogen Bond; Electrostatic | Salt Bridge | B:ARG59:NH1 | H-Donor | C:ASP560:OD2 | H-Acceptor |
| B:ARG50:NH1 - C:ASP560:OD1 | 5.51884 | Electrostatic | Attractive Charge | B:ARG50:NH1 | Positive | C:ASP560:OD1 | Negative |
| B:ARG50:NH2 - C:BLU558:OE2 | 4.67324 | Electrostatic | Attractive Charge | B:ARG50:NH2 | Positive | C:GLU558:OE2 | Negative |
| B:ARG59:NH1 - C:GLU558:OE2 | 4.85457 | Electrostatic | Attractive Charge | B:ARG59:NH1 | Positive | C:GLU558:OE2 | Negative |
| A:ARG66:NH2 - C:GLU558:OE1 | 5.45049 | Electrostatic | Attractive Charge | A:ARG66:NH2 | Positive | C:GLU598:OE1 | Negative |
| A:ASN30:ND2 - C:GLN602:OE1 | 3.2212 | Hydrogen Bond | Conventional Hydrogen Bond | A:ASN30:ND2 | H-Donor | C:GLN602:OE1 | H-Acceptor |
| A:THR94:OG1 - C:ASP560:OD2 | 2.82322 | Hydrogen Bond | Conventional Hydrogen Bond | A:THR94:OG1 | H-Donor | C:ASP560:OD2 | H-Acceptor |
| C:LYS569:NZ - A:TYR92:OH | 2.95716 | Hydrogen Bond | Conventional Hydrogen Bond | C:LYS569:NZ | H-Donor | A:TYR92:OH | H-Acceptor |
| C:LYS592:NZ - BGLY103:O | 2.41699 | Hydrogen Bond | Conventional Hydrogen Bond | C:LYS593:NZ | H-Donor | B:GLY103:O | H-Acceptor |
| B:GLY103:CA - C:ASP570:OD2 | 3.66277 | Hydrogen Bond | Carbon Hydrogen Bond | B:GLY103:CA | H-Donor | C:ASP570:OD2 | H-Acceptor |
| A:HIS91:CD2 - C:PRO571:O | 2.88782 | Hydrogen Bond | Carbon Hydrogen Bond | A:HIS91:CD2 | H-Donor | C:PRO571:O | H-Acceptor |
| C:PRO572:CA - A:TYR92:O | 3.24352 | Hydrogen Bond | Carbon Hydrogen Bond | C:PRO572:CA | H-Donor | A:TYR92:O | H-Acceptor |
| B:TYR233:OH - C:PHE573 | 4.09465 | Hydrogen Bond | Pi-Donor Hydrogen Bond | B:TYR233:OH | H-Donor | C:PHE573 | Pi-Orbitals |
| B:TYR33 - C:PHE573 | 5.30661 | Hydrophobic | Pi-Pi Stacked | B:TYR33 | Pi-Orbitals | C:PHE573 | Pi-Orbitals |
| B:TYR105 - C:PHE573 | 4.81559 | Hydrophobic | Pi-Pi T-shaped | B:TYR105 | Pi-Orbitals | C:PHE573 | Pi-Orbitals |
| A:ALA32 - C:PRO571 | 4.20712 | Hydrophobic | Alkyl | A:ALA32 | Alkyl | C:PRO571 | Alkyl |
| B:TYR57 - C:PRO557 | 4.20034 | Hydrophobic | Pi-Alkyl | B:TYR57 | Pi-Orbitals | C:PRO557 | Alkyl |
| B:TRP99 - C:PRO572 | 5.45598 | Hydrophobic | Pi-Alkyl | B:TRP99 | Pi-Orbitals | C:PRO572 | Alkyl |
| A:PHE53 - C:PRO603 | 4.09395 | Hydrophobic | Pi-Alkyl | A:PHE53 | Pi-Orbitals | C:PRO603 | Alkyl |
| A:TYR92 - C:PRO571 | 5.22151 | Hydrophobic | Pi-Alkyl | A:TYR92 | Pi-Orbitals | C:PRO571 | Alkyl |

Based on the table of non-covalent interactions occurring between Trastuzumab fab and HER2 protein, certain interactions were chosen to abolish in order to disrupt binding interactions.

Proposed Mutation Combinations to Disrupt Binding Interactions

The following four amino acid residue mutations were selected based on the non-bond interaction data in order to maintain the original Trastuzumab sequences.

Case of Trastuzumab Heavy Chain Arginine 50 Residue:

This arginine residue of the antibody makes salt bridge interactions with HER2 residues glutamate 558 and aspartate 560. Arginine 50 was mutated into a glutamate residue in order to create a repulsion of HER2 residues glutamate 558 and aspartate 560.

Case of Trastuzumab Heavy Chain Arginine 59 Residue:

This arginine residue of the antibody makes salt bridge interactions with HER2 residues glutamate 558 and aspartate 560. Arginine 59 was mutated into a glutamate residue in order to create a repulsion of HER2 residues glutamate 558 and aspartate 560.

Case of Tyrosine Heavy Chain Arginine 33 Residue:

This Tyrosine 33 residue of antibody makes Pi interactions with HER2 residue phenylalanine 573. Tyrosine 33 was mutated into an alanine residue in order to disrupt these Pi interactions occurring between antibody and its target.

Case of Tyrosine Heavy Chain Arginine 105 Residue:

This tyrosine 105 residue of antibody makes Pi interactions with HER2 residue phenylalanine 573. Tyrosine 105 was mutated into an alanine residue in order to disrupt these Pi interactions occurring between antibody and its target.

The particular combinations of amino acid residues proposed to be mutated are presented in Table 6. These combinations lead to two variants of Trastuzumab antibody.

TABLE 6

Knockout Variants of Trastuzumab (TrasKO)

| Trastuzumab Fab heavy chain (SEQ ID NO: 2) | Variant1 Fab heavy chain (TrasKO1) (SEQ ID NO: 3) | Variant2 Fab heavy chain (TrasKO2) (SEQ ID NO: 4) | Variant3 Fab heavy chain (TrasKO3) (SEQ ID NO: 5) |
|---|---|---|---|
| Arginine 50 | Glutamate 50 | Glutamate 50 | |
| Arginine 59 | Glutamate 59 | Glutamate 59 | |
| Tyrosine 33 | Alanine 33 | | Alanine 33 |
| Tyrosine 105 | Alanine 105 | | Alanine 105 |

Variant1 Fab comprises all four point mutations. Variant2 Fab with the reversion of two positively charged residues into negatively charged residues possess a repulsive area for HER2 protein into the original Trastuzumab HER2 binding region. Variant3 Fab with the disrupting of Pi interactions with HER2 Phenylalanine 573 induces destabilization of TrastuzumAb-HER2 complex. All three dsTrasKO variants were found to abolish binding to HER2 (see FIG. 5A-FIG. 5B). Variant 2 (dsTrasKO2) was identified as the best producer.

Example 5: Evaluation of dstrasko2 as Replacement Scaffold for CH1/CL

The dsTrasKO variants were evaluated in Pseudo-IgG (monospecific) format (see FIG. 6A) and pseudo-Fab (see FIG. 6B). The tested Pseudo IgG and pseudo-Fab formats had expression and purification characteristics similar to that of the parent antibody (see Table 7).

TABLE 7

| Expression and Purification Results of Pseudo-IgG Antibodies with the dsTrasKO2 domain replacement of CH1/CL | | | | |
|---|---|---|---|---|
| ID | Sequence | Format | Expression Yield [mg/L] | Monomeric fraction after Protein A |
| 19 (SEQ ID NO: 42 and 43) | PD1 mAb | Pseudo-IgG | 243 | 67% |
| 20 (SEQ ID NO: 44 and 45) | CTLA4 mAb | Pseudo-IgG | 153 | 84% |
| 21 (SEQ ID NO: 46 and 47) | IL4 mAb | Pseudo-IgG | 45 | 100% |

TABLE 7-continued

| Expression and Purification Results of Pseudo-IgG Antibodies with the dsTrasKO2 domain replacement of CH1/CL | | | | |
|---|---|---|---|---|
| ID | Sequence | Format | Expression Yield [mg/L] | Monomeric fraction after Protein A |
| 22 (SEQ ID NO: 48 and 49) | IL13 mAb | Pseudo-IgG | 114 | 94% |
| 23 (SEQ ID NO: 50 and 51) | IL13 mAb | Pseudo-Fab | 243 | 94% |

Example 6: Evaluation of Bispecific Antibodies with Native Structure Using dstrasko2 as Replacement Scaffold for CH1/CL The dsTrasKO2 domain was evaluated as a replacement scaffold in a bispecific antibody with a native IgG structure. In particular, an anti-IL4-dsTrasKO(Var2)×anti-IL13-hu-IgG1 bispecific design with RF mutations in the Fc was synthesized (see FIG. 7).

i. Expression of dsTrasKO2 Bispecific Molecules

The expression plasmids encoding both heavy chains (dsTrasKO2-knob and WT-hole) and both light chains (dsTrasKO and WT-Kappa/lambda) of the corresponding constructs were propagated in *E. coli* DH5a. Plasmids used for transfection were prepared from *E. coli* using the Qiagen EndoFree Plasmid Mega Kit.

HEK 293-FS cells growing in F17 serum free suspension culture (Invitrogen) were transfected with indicated light chain (LC) and heavy chain (HC) plasmids using polyethylenimine transfection reagent. After 7 days of cultivation at 37° C. cells were removed by centrifugation and the supernatant was passed over a 0.22 μm filter to remove particles.

For purification, the antibody was captured on MabSelect SuRe column (Cat. No.: 11-0034-93, GE Healthcare) and eluted with 0.1M Citrate buffer pH 3.0 and directly desalted using a HiPrep 26/10 desalting column (Cat. No.: 17-05087-02, GE Healthcare). Possible homodimeric dsTrasKO2 monospecific molecules will be sorted out by using an additional KappaSelect capture step (0.1M Glycine pH 2,7 elution buffer) (see FIG. 14). After polishing the protein by size exclusion chromatography (SEC, carried out as described in Example 2 above) using a Superdex200 26/60 (GE) and a final ultrafiltration concentration step the protein was used for further characterization. See Table 8 for purification results of dsTrasKO2 bispecific constructs. See FIG. 7A-FIG. 7D for representative bispecific design and purification results.

TABLE 8

| Purification Yields of dsTrasKO2 Bispecific constructs | | | | | | |
|---|---|---|---|---|---|---|
| dsTrasKO-huFc1 (Knob) | IL4 mAb | CTLA4 mAb | PD1 mAb | IL13 mAb | IL4 mAb | CTLA4 mAb |
| huIgG1 (hole-RF) | IL13 mAb | IL13 mAb | IL13 mAb | PD1 mAb | PD1 mAb | PD1 mAb |
| ID | 28 (SEQ ID NO: 68 and 69 and SEQ ID NO: 70 and 71) | 30 | 26 (SEQ ID NO: 60 and 61 and SEQ ID NO: 62 and 63) | 25 (SEQ ID NO: 56 and 57 and SEQ ID NO: 58 and 59) | 24 (SEQ ID NO: 52 and 53 and SEQ ID NO: 54 and 55) | 27 (SEQ ID NO: 64 and 65 and SEQ ID NO: 66 and 67) |
| Yield [mg] | 51.6 | 64 | 42.4 | 70 | 45.4 | 62.7 |
| % Monomer (SEC) | 93.60% | 91.30% | 61.30% | 95.40% | 95.60% | 84.10% |

Evaluation of Antigen Binding of Bispecific Antibodies Comprising dsTrasKO2 Replacement of a CH1/CL Pair.

Surface plasmon resonance (SPR) was used to assess the binding of antigens to antibody. Binding of antigens to the antibody constructs was measured using surface plasmon resonance (SPR) with a BIAcore 3000 instrument (GE Healthcare) with HBS-EP buffer (GE Healthcare). Human IL4 (IL004, Millipore) and human IL13 (IL012, Millipore), human HER2 (1129-ER, R&D Systems), human TNFα (H8916, SIGMA Aldrich), human CTLA4 (CT4-H5229, ACRO Biosystems), human PD-1 (8986-PD, R&D Systems), and human IL6Ra (227-SR/CF, R&D Systems) were used as antigens. The anti-human Fc capture antibody (human antibody capture kit, GE Life Sciences) was immobilized via primary amine groups (11000 RU) on a research grade CM5 chip (GE Life Sciences) using standard procedures. The ligands were captured at a flow rate of 10 µl/min with an adjusted RU value that resulted in maximal analyte binding of 30 RU. Binding tests with HER2 was performed by capture of the antigen with the anti-human Fc antibody. The tested antibody constructs were used as analytes and injected at 100 nM concentration for 240 sec with a dissociation time of 300 sec at a flow rate of 30 µL/min. Binding kinetics measurements were done using the captured antibodies with injects of two-fold serial dilutions of the analytes of 3 nM to 100 nM. For human IL4 and IL13 a dilution series of 0.1 nM to 3 nM and 0.8 nM to 25 nM, respectively were used. Chip surfaces were regenerated with 2 min injects of the regeneration buffer provided with the capture kit. Sensorgrams were double referenced with a blank chip surface and HBS-EP buffer blanks. Data analysis was performed using the BIAevaluation software v4.1. The binding characteristics of mAbs, pseudo-IgGs and bispecifics are shown in Table 9 below.

The SPR results showed that various VH/VLs fused to dsTrasKO2 retain the parental antigen binding affinities, including bispecific antibodies.

Analysis of Protein Integrity

Protein integrity and potential mispairing of heterodimeric constructs was analyzed by LC-mass spectrometry (LC-MS). Protein samples were deglycosylated with 12.5 µg of protein diluted to 0.5 mg/ml in D-PBS buffer treated with 0.5 µl PNGaseF (glycerol free, New England Biolabs) at 37° C. for 15 hours. The LC-MS analysis was performed using a 6540 UHD Accurate-Mass Q-TOF LC/MS instrument (Agilent). Reversed phase (RP) chromatography was done using a Poroshell 300SB-C8 5 µm, 75×0.5 mm (Agilent) with guard column Poroshell 300SB-C8, 5 µm, 2.1×12.5 mm (Agilent) at 180 µL/min. Eluents were LC water, 0.1% formic acid (A) and 90% acetonitrile, 10% LC water, 0.1% formic acid (B). 2 µg of protein were injected onto the column and eluted using a linear gradient from 0% to 100% B in 13 minutes. Data analysis was done using MassHunter software B.06 (Agilent). Molecular masses were calculated based on the amino acid sequences of the proteins using GPMAW software version 9.13a2 (Lighthouse data). The dsTrasKO2-antibody fusion proteins were shown to be mostly intact and to exhibit the correct heterodimer pairing (see Table 10 below).

TABLE 9

Binding kinetics by SPR: Comparison of mAbs, pseudo-IgGs and bispecifics

| | | | Binding kinetics by SPR | | |
| --- | --- | --- | --- | --- | --- |
| ID | Construct | Antigen | ka [1/MXs] | kd [1/s] | KD [nM] |
| 18 (SEQ ID NO: 40 and 41) | IL4 mAb | IL4 | 1.04E+08 | 1.61E−04 | 1.55E−12 |
| 21 (SEQ ID NO: 46 and 47) | IL4 pseudo-IgG | IL4 | 7.43E+07 | 1.44E−04 | 1.94E−12 |
| 24 (SEQ ID NO: 52 and 53 and SEQ ID NO: 54 and 55) | IL4 × PD1 | IL4 | 9.35E+07 | 1.27E−04 | 1.36E−12 |
| 3 (SEQ ID NO: 10 and 11) | IL13 mAb | IL13 | 1.28E+06 | 3.46E−05 | 2.69E−11 |
| 22 (SEQ ID NO: 48 and 49) | IL13 pseudo-IgG | IL13 | 1.54E+06 | 6.56E−07X | 4.25E−13 |
| 25 (SEQ ID NO: 56 and 57 and SEQ ID NO: 58 and 59) | IL13 × PD1 | IL13 | 1.28E+06 | 1.84E−07X | 1.44E−13 |
| 26 (SEQ ID NO: 60 and 61 and SEQ ID NO: 62 and 63) | PD1 × IL13 | IL13 | 2.92E+06 | 1.66E−05 | 5.68E−12 |
| 12 (SEQ ID NO: 28 and 29) | CTLA4mAb | CTLA-4 | 1.62E+05 | 1.11E−03 | 6.83E−09 |
| 20 (SEQ ID NO: 44 and 45) | CTLA4 pseudo-IgG | CTLA-4 | 2.52E+05 | 9.64E−04 | 3.82E−09 |
| 27 (SEQ ID NO: 64 and 65 and SEQ ID NO: 66 and 67) | CTLA4 × PD1 | CTLA-4 | 2.52E+05 | 1.28E−03 | 5.08E−09 |
| 15 (SEQ ID NO: 34 and 35) | PD1 mAb | PD-1 | 2.14E+05 | 2.05E−03 | 9.56E−09 |
| 19 (SEQ ID NO: 42 and 43) | PD1 pseudo-IgG | PD-1 | 2.66E+05 | 2.86E−03 | 1.08E−08 |
| 26 (SEQ ID NO: 60 and 61 and SEQ ID NO: 62 and 63) | PD1 × IL13 | PD-1 | 1.31E+05 | 2.90E−03 | 2.21E−08 |
| 24 (SEQ ID NO: 52 and 53 and SEQ ID NO: 54 and 55) | PD1 × IL4 | PD-1 | 2.19E+05 | 2.10E−03 | 9.60E−09 |
| 27 (SEQ ID NO: 64 and 65 and SEQ ID NO: 66 and 67) | CTLA4 × PD1 | PD-1 | 1.63E+05 | 1.10E−03 | 6.78E−09 |

TABLE 10

LC-MS results of dsTrasKO2-antibody fusion proteins

| Batch ID | Sample | Expected (Da) X | Measured (Da) | Difference (Da) | Comment | Spectrum peaks | Pairing | Dimer |
|---|---|---|---|---|---|---|---|---|
| 21 (SEQ ID NO: 46 and 47) | 1 | 153599.86 | 153613.37 | 13.51 | intact | 1 | LC1 + HC1 LC2 + HC2 | Heterodimer |
| 20 (SEQ ID NO: 44 and 45) | 1 | 152538.62 | 152550.41 | 11.79 | intact | 1 | LC1 + HC1 LC2 + HC2 | Heterodimer |
| 19 (SEQ ID NO: 42 and 43) | 1 | 151135.00 | 151141.57 | 6.57 | intact | 2 | LC1 + HC1 LC2 + HC2 | Heterodimer |
| 28 (SEQ ID NO: 68 and 69 and SEQ ID NO: 70 and 71) | 1 | 149342.54 | 149222.42 | −120.12 | Cter Lys clipping | 1 | LC2 + HC2 LC1 + HC1 | Heterodimer |
| 26 (SEQ ID NO: 60 and 61 and SEQ ID NO: 62 and 63) | 1 | 148110.11 | 147988.32 | −121.79 | Cter Lys clipping | 1 | LC2 + HC2 LC1 + HC1 | Heterodimer |
| 25 (SEQ ID NO: 56 and 57 and SEQ ID NO: 58 and 59) | P1 | 147981.92 | 147988.31 | 6.39 | intact | 1 | LC2 + HC2 LC1 + HC1 | Heterodimer |
| 24 (SEQ ID NO: 52 and 53 and SEQ ID NO: 54 and 55) | P1 | 148541.65 | 148548.27 | 6.62 | intact | 1 | LC1 + HC1 LC2 + HC2 | Heterodimer |
| 27 (SEQ ID NO: 64 and 65 and SEQ ID NO: 66 and 67) | P1 | 148011.02 | 148017.36 | 6.34 | intact | 1 | LC1 + HC1 LC2 + HC2 | Heterodimer |
| 29 (SEQ ID NO: 72 and 73 and SEQ ID NO: 74 and 75) | P1 | 147309.22 | 147315.24 | 6.02 | intact | 1 | LC1 + HC1 LC2 + HC2 | Heterodimer |

Figure 8:
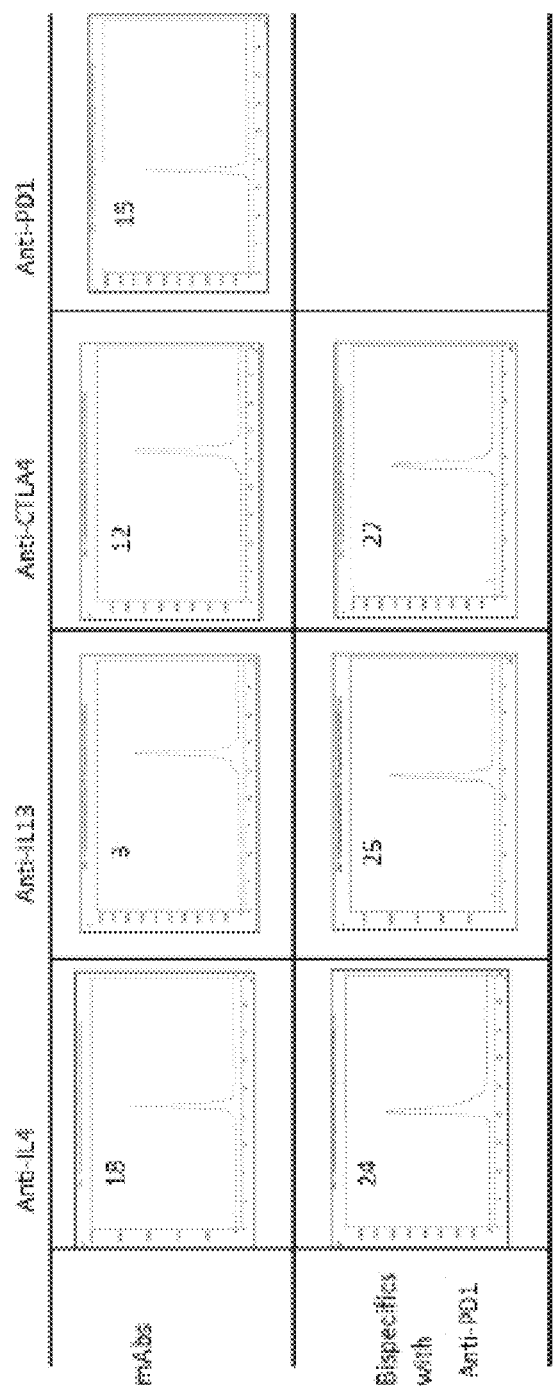
FIG. 8 shows analytical hydrophobic-interaction chromatography (HIC) results indicating that dsTrasKO2-bispecific constructs were correctly paired and did not contain unexpected species.

In addition to the LC-MS analysis, the bispecific samples were also analyzed by hydrophobic-interaction chromatography (HIC) to detect potential mispaired or unexpected species. Analytical HIC was performed using a LC10 HPLC instrument (Shimadzu) with a TSKgel Ether-5PW 10 μm, 2×75 mm (Tosoh Bioscience) at 25° C. The analysis was run at a flow rate of 0.1 ml/min with detection at 280 nm. 5 μg of undiluted protein sample were applied onto the column. Gradient elution was from 0 to 30 min (0% to 100% B) followed by 10 min 100% B and 15 min of re-equilibration. Buffer A was composed of 1.5 M ammonium sulfate, 25 mM sodium phosphate pH 7.0. Buffer B was composed of 25 mM sodium phosphate pH 7.0. Data evaluation was performed using LabSolutions software v5.85 (Shimadzu). The data showed that the dsTrasKO2-bispecific samples had a homogeneous HIC profile, indicating that there were no unexpected species and that the bispecific samples had correct pairing (see FIG. 8).

Thermal Stability: Comparison of Pseudo-IgGs and Bispecifics

The thermal stability of the dsTrasKO2 pseudo-IgG and bispecific samples was assessed as described in Example 2 above. The melting points (Tm) were determined using differential scanning fluorimetry (DSF) as described in Example 3. The dsTrasKO2 based constructs showed a reduced melting temperature in comparison to the parent monoclonal IgG and no impairment of stability was detected in a 2 week thermal stability assay (40° C., 4° C., and −80° C.) (see Table 11 below).

TABLE 11

Thermal Stability of dsTrasKO2- Antibody Constructs.

| ID | Construct | Melting temperature (° C.) | Stability (2w @40° C.), aggregation [%] | | |
|---|---|---|---|---|---|
| | | | 2w 40° C. | 4° C. | −80° C. |
| 18 (SEQ ID NO: 40 and 41) | IL4 mAb | 70 | 81 | 0 | 0 | 0 |
| 21 (SEQ ID NO: 46 and 47) 24_P1 | IL4 pseudo-IgG | 68 | — | 1 | 1 | 1 |

TABLE 11-continued

Thermal Stability of dsTrasKO2- Antibody Constructs.

| ID | Construct | Melting temperature (° C.) | Stability (2w @40° C.), aggregation [%] | | |
|---|---|---|---|---|---|
| | | | 2w 40° C. | 4° C. | −80° C. |
| (SEQ ID NO: 52 and 53 and SEQ ID NO: 54 and 55) | IL4 × PD1 | 68 | — | 2 | 2 | 2 |
| 3 (SEQ ID NO: 10 and 11) | IL13 mAb | 70 | 80 | 0 | 0 | 0 |
| 22 (SEQ ID NO: 48 and 49) | IL13 pseudo-IgG | 68 | — | 1 | 0 | 0 |
| 25 (SEQ ID NO: 56 and 57 and SEQ ID NO: 58 and 59) | IL13 × PD1 | 67 | — | 1 | 0 | 0 |
| 12 (SEQ ID NO: 28 and 29) | CTLA4 mAb | 69 | 75 | 1 | 1 | 1 |
| 20 (SEQ ID NO: 44 and 45) | CTLA4 pseudo-IgG | 67 | — | 0 | 0 | 0 |
| 27 (SEQ ID NO: 64 and 65 and SEQ ID NO: 66 and 67) | CTLA4 × PD1 | 67 | — | 0 | 0 | 0 |
| 15 (SEQ ID NO: 34 and 35) | PD1 mAb | 68 | — | 0 | 0 | 0 |
| 19 (SEQ ID NO: 42 and 43) | PD1 pseudo-IgG | 54 | 68 | 3× | 0 | 0 |
| 26 (SEQ ID NO: 60 and 61 and SEQ ID NO: 62 and 63) | PD1 × IL13 | | | 3 | 0 | 0 |

Example 7: Crystal Structure of the Pseudo-Fab IL-13

Crystallization of dsTrasKO2-IL13-pseudoFab was performed for structural studies. Crystallization trials were set up as sitting-drop experiments in standard two-drop, 96-well MRC plates using a 1:1 protein:reservoir ratio and were incubated at 20° C. Both TrasKO2-CH1/CL and anti-IL13-TrasKO2 were screened for crystallization hits against a variety of commercially available sparse-matrix screens. Screening drops for TrasKO2-CH1/CL (stock at 15 mg/ml) and anti-IL13-TrasKO2 (stock at 15.6 mg ml) in 20 mM HEPES pH 7.5, 0.1 M sodium chloride were prepared by mixing 100 nl protein solution with 100 nl reservoir solution and equilibrated in sitting drop vapor diffusion experiments against 80 µl reservoir. Final crystals of TrasKO2-CH1/CL suitable for data collection and structure solution were grown at 20° C. with a reservoir solution consisting of 0.1 M sodium phosphate citrate pH 4.2, 20% (w/v) polyethylene glycol 8000 and 0.2 M sodium chloride. Diffraction-quality anti-IL13-TrasKO2 crystals were grown with a reservoir solution consisting of 0.1 M CHES pH 9.5 and 20% (w/v) polyethylene glycol 8000. All crystals were cryo-protected prior to flash-cooling in liquid nitrogen via the addition of 25% (w/v) ethylene glycol (final concentration).

Data Collection and Structure Determination

Diffraction data were collected on beamline PSII at the Swiss Light Source (SLS), Villingen, Switzerland. The diffraction data were processed using a combination of XDS (Kabsch, 2010) and AIMLESS (Evans & Mushudov, 2013) of the CCP4 program suite (Winn et al., 2011). TrasKO2-CH1/CL crystallized in space group I23 with cell parameter 153.23 Å, 153.23 Å, 153.23 Å, 90.00°, 90.00°, 90.00°, the data extended to a resolution of 3.70 Å. Crystals of anti-IL13-TrasKO2 belonged to space group P3221 with cell parameter 145.37 145.37 52.06 90.00 90.00 120.00 and diffracted to 1.85 Å.

Figure 9:
FIG. 9 schematically depicts the crystal structure of a Pseudo-Fab IL13-dsTrasKO2 construct having the ultrastructure of FIG. 6A. The structure was solved at 3.75 Å. The structure shows the superposition of IL13-VH/VL domains of TrasKO2-IL13 pseudo-Fab (light grey) and Fab anti-IL13 (dark grey).

The structures were solved by molecular replacement employing the CCP4 implementation of Phaser (McCoy et al., 2007). For TrasKO2-CH1/CL a modified version of the trastuzumab-VH-VL domain and the CH1/CL domain of pdb-entry 1n8z were used as search models. Molecular replacement on anti-IL13-TrasKO2 was performed with the anti-IL13 VH/VL domain of the Sanofi internal structure of Fab anti-IL13 and the modified version of the 1n8z VH/VL domain as phasing models. The atomic models were constructed by iterative rounds of manual model building and refinement using Coot (Emsley et al., 2010) and Refine (Bricogne, 2017). The R- and R-free factors of the final models are 19.2/23.2 for TrasKO2-CH1/CL and 21.0/31.2 for anti-IL13-TrasKO2 (see FIG. 9 for the crystal structure).

Example 8: Evaluation of Bispecific Antibodies with a Tandem Structure Using Dstrasko2 as Replacement Scaffold CH1/CL The dsTrasKO2 domain was evaluated as a replacement scaffold in a bispecific tandem IgG design. In particular, an anti-GITR-dsTrasKO2×anti-OX40-kappa]-huIgG1 tandem IgG design was synthesized and tested (see FIG. 10-12).

Expression of dsTrasKO2 Bispecific Tandem Molecules

The expression plasmids encoding the heavy and both light chains (dsTrasKO and WT-Kappa/lambda) of the corresponding constructs were propagated in E. coli DH5a. Plasmids used for transfection were prepared from E. coli using the Qiagen EndoFree Plasmid Mega Kit.

HEK 293-FS cells growing in F17 serum free suspension culture (Invitrogen) were transfected with indicated LC and HC plasmids using Polyethylenimine transfection reagent. After 7 days of cultivation at 37° C. cells were removed by centrifugation and the supernatant was passed over a 0.22 µm filter to remove particles.

Figure 14:
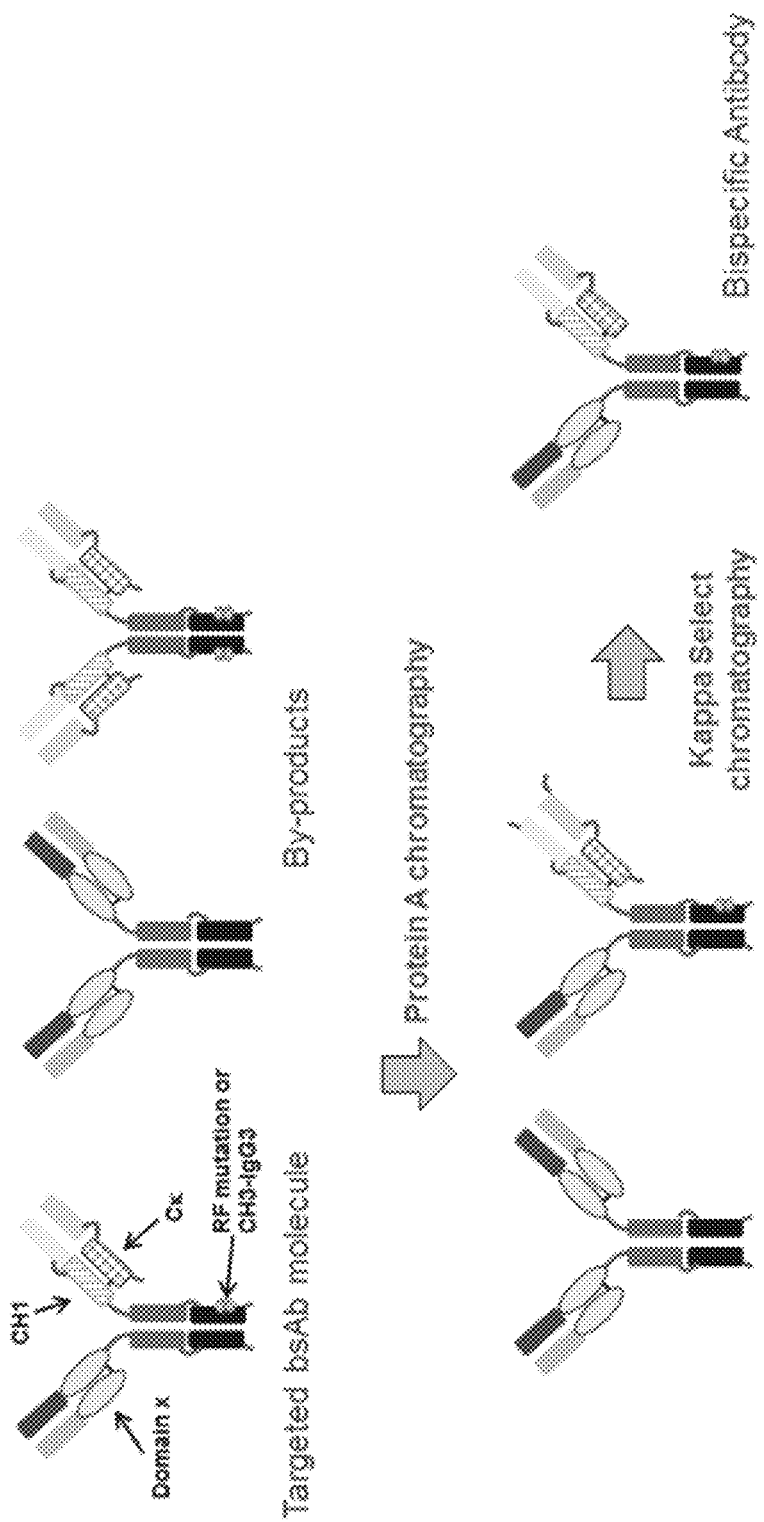
FIG. 14 depicts a schematic of a two-step purification process used to ensure correct light chain pairing with dsTrasKO2 knockout bispecific molecules.

For purification, the antibody was captured on MabSelect SuRe column (Cat. No.: 11-0034-93, GE Healthcare) and eluted with 0.1M Citrate buffer pH 3.0 and directly desalted using a HiPrep 26/10 desalting column (Cat. No.: 17-05087-02, GE Healthcare). Possible homodimeric dsTrasKO2 monospecific molecules will be sorted out by using an additional KappaSelect capture step (0.1M Glycine pH 2,7 elution buffer) (see FIG. 14). After polishing the protein by size exclusion chromatography (SEC) using a Superdex200 26/60 (GE) and a final ultrafiltration concentration step the protein was used for further characterization. See FIG. 12A-FIG. 12D for representative bispecific design and purification results.

Example 9: Evaluation of Trispecific Antibodies with a CODV Structure Using dstrasko2 as Replacement Scaffold for CH1/CL The dsTrasKO2 domain was evaluated as a replacement scaffold in a trispecific crossover variable domain (CODV) design. In particular, a CODV-anti-Ox40×anti-PD1]×anti-CD137—dsTrasKO2-huIgG1-LALA-KIH-RF construct was synthesized and tested (see FIG. 13).

Expression of dsTrasKO2 Trispecific CODV Molecules

The expression plasmids encoding the heavy and both light chains (dsTrasKO and WT), and the expression plasmids encoding the both heavy (CODV-knob and dsTrasKO2-hole) and both light chains (CODV and dsTrasKO) of the corresponding constructs were propagated in E. coli DH5a. Plasmids used for transfection were prepared from E. coli using the Qiagen EndoFree Plasmid Mega Kit.

HEK 293-FS cells growing in F17 serum free suspension culture (Invitrogen) were transfected with indicated LC and HC plasmids using Polyethylenimine transfection reagent. After 7 days of cultivation at 37° C. cells were removed by centrifugation and the supernatant was passed over a 0.22 µm filter to remove particles.

For purification, the antibody was captured on MabSelect SuRe column (Cat. No.: 11-0034-93, GE Healthcare) and eluted with 0.1M Citrate buffer pH 3.0 and directly desalted using a HiPrep 26/10 desalting column (Cat. No.: 17-05087-02, GE Healthcare). Sample was further purified on a MonoS cation exchange column (Cat. No.: 17-5169-01, GE Healthcare, 0-1M NaCl salt gradient in 0.01M L-Histidine pH 6.0 buffer). After ultrafiltration concentration step the protein was used for further characterization.

See FIG. 13A-FIG. 13D for representative trispecific design and purification results.

Example 10: Evaluation of Bispecific T Cell Engager Antibodies Using Dstrasko2 as Replacement Scaffold for CH1/CL General Methods
Analytical Size Exclusion Chromatography (SEC)

Analytical SEC was performed using a BioSECcurity instrument (PSS Polymer) with an AdvanceBio 300 column (4.6 mm×300 mm) and AdvanceBio 300 guard column (Agilent Technologies) at 25° C. The analysis was run at a flow rate of 0.5 ml/min using 2× concentrated D-PBS buffer (Thermo Fisher Scientific) with detection at 280 nm. 10 µl of protein sample (at 1 mg/ml) were applied onto the column. Data evaluation was performed using WinGPC software v8.1 (PSS Polymer). For estimation of the molecular weight the SEC column was calibrated with a protein calibration standard mix (Agilent Technologies).

Analytical Hydrophobic Interaction Chromatography (HIC)

Analytical HIC was performed using a LC10 HPLC instrument (Shimadzu) or a Vanquish HPLC instrument (Thermo Fisher Scientific) equipped with a TSKgel Butyl-NPR column (2.5 µm, 4.6×35 mm) (Tosoh Bioscience) at 25° C. The analysis was run at a flow rate of 1 ml/min with detection at 280 nm. 5 µg of undiluted protein sample were applied onto the column. Gradient elution was from 15% B to 85% B in 7 min followed by 1 min to 100% B, then 1 min to 15% B and then 3 minutes equilibration at 15% B. Buffer A was composed of 1.5 M ammonium sulfate, 25 mM sodium phosphate pH 7.0. Buffer B was composed of 25 mM sodium phosphate pH 7.0. Data evaluation was performed either using LabSolutions software v5.85 (Shimadzu) or Chromeleon 7 software (Thermo Fisher Scientific).

nanoDSF

Onset temperatures (Tonset) and melting points (Tm) of protein denaturation were determined using nano differential scanning fluorimetry (nanoDSF). Samples were diluted in formulation buffer to a final concentration of 0.5 µg/µl and loaded into nanoDSF capillaries (Nanotemper Technologies) in duplicates. All measurements were done using a Prometheus NT.plex nanoDSF device (Nanotemper Technologies). Heating rate was 1° C. per minute from 20° C. to 95° C. Data were recorded using PR. ThermControl Software v2.3.1 (Nanotemper Technologies) and analyzed using PR. Stability Analysis Software v1.0.3 (Nanotemper Technologies).

Surface Plasmon Resonance (SPR)

Binding of antigens to the antibody constructs was measured using surface plasmon resonance (SPR) with a BIAcore 8K instrument (GE Healthcare) with HBS-EP+ buffer (GE Healthcare). For binding kinetics and affinity determination human CD3εδ-Fc-His and human CD123-Fc-His fusion proteins (both from internal source) were used as antigens. The anti-His capture antibody (His capture kit, GE Life Sciences) was immobilized via primary amine groups (11000 RU) on a research grade CM5 chip (GE Life Sciences) using standard procedures. Antigens were captured by the anti-His capture chip surface at a flow rate of 10 µL/min for 90 sec to reach antibody binding levels between 10 and 30 RU. The antibodies were injected for 240 sec at 30 µL/min in a twofold dilution series from 100 nM to 3.1 nM for determination of CD123 affinities and from 400 nM to 3.1 nM or 100 nM to 3.1 nM for determination of CD3 binding affinities. Dissociation was measured at 30 µL/min by injection of HBS-EP+ buffer for 1200 sec. The chip surface was regenerated by inject of regeneration buffer (His capture kit, GE Life Sciences). Sensorgrams were double referenced with a blank chip surface and H BS-EP+ buffer blanks. Data were fitted with a 1:1 Langmuir binding model for determination of kinetic and affinity constants ka, kd and KD using Biacore 8K Evaluation software v1.11.7442 (GE Healthcare).

For assessment of relative binding levels (% Rmax) of the antibodies for CD3 and CD123, the antibodies were captured by anti-Fc affinity capture to the sensor chip. In this assay human CD3εδ-FLAG-His (#CT038-H2508H, Sino Biological) and human CD123 (#301-R3/CF, R&D Systems) proteins were used. The anti-human Fc capture antibody (human antibody capture kit, GE Life Sciences) was immobilized via primary amine groups (11000 RU) on a research grade CM5 chip (GE Life Sciences) using standard procedures. The antibodies were captured at a flow rate of 10 µl/min with an adjusted RU value that resulted in maximal analyte binding of 10 to 30 RU. The antigens were used as analytes and injected at either 400 nM and 100 nM concentration for CD3εδ-FLAG-His or at 100 nM concentration for CD123. The antigens were injected for 240 sec with a dissociation time of 300 sec at a flow rate of 30 µL/min. Chip surfaces were regenerated with 2 min injects of the regeneration buffer provided with the capture kit. Sensorgrams were double referenced with a blank chip surface and HBS-EP buffer blanks. Data analysis and binding level determination were performed using the Biacore 8K Evaluation software v1.11.7442 (GE Healthcare). The % Rmax values were calculated using the maximum binding level divided by the theoretical Rmax value. The theoretical Rmax values were calculated from the capture level Rcapture, the binding stochiometry N and the molecular weight of antibody Mw(Ab) and antigen Mw(Ag) with Rmax=Rcapture*N*(Mw(Ag)/Mw(Ab)).

Mass Spectrometry

Protein integrity and potential mispairing of heterodimeric constructs was analyzed by LC-mass spectrometry (LC-MS). Protein samples were deglycosylated with 12.5 µg of protein diluted to 0.17 mg/mL in LC-MS grade water (Thermo Scientific) treated with 0.5 µL PNGaseF (glycerol free, New England Biolabs) at 37° C. for 16 hours. The LC-MS analysis was performed using a Orbitrap Fusion Lumos Tribrid Mass Spectrometer instrument. Reversed phase (RP) chromatography was done using a MabPac RP HPLC column, analytical 4 µm particle size, 2.1×100 mm (Thermo Scientific) at 300 µL/min. Eluents were LC water, 0.1% formic acid (A) and 90% acetonitrile, 10% LC water, 0.1% formic acid (B). 2 µg of protein solution was injected onto the column and eluted using a linear gradient from 0% to 95% B in 12 minutes. Data analysis was done using Expressionist software 13.0.3 (Genedata). Molecular masses were calculated based on the amino acid sequences of the proteins using GPMAW software version 10.32b1 (Lighthouse data).

Cytotoxicity Assay with Bispecific TrasKO2 Molecules

Bispecific TrasKO2 molecules were analyzed in cytotoxicity assays using primary human T cells. Human peripheral mononuclear cells from blood of healthy donors were isolated in Leucosep-Tubes (Greiner Bio-One, #227290) using 15 mL Histopaque (Sigma-Aldrich, #10771) and centrifugation for 10 min at 1000×g. Isolated PBMCs were washed twice in autoMACS Rinsing buffer (Miltenyi Biotec, #130-091-222) supplemented with 5% MACS BSA stock solution (Miltenyi Biotec, #130-091-370). Primary human T cells were isolated from human PBMCs with the MACSpro Separator (Miltenyi Biotec) and the Pan T cell Isolation Kit (Miltenyi Biotec, #130-096-535) using manufactures' protocols. Isolated human T cells were resuspended at $5 \times 10^6$ cells/mL in RPMI GlutaMAX I media (Gibco, #72400) supplemented with 10% FCS HI (Gibco, #10082-147). Prior to cytotoxicity assay, THP-1 target cells (ADCC TIB-202) were stained with 1 µM CFSE (Invitrogen, #C1157) for 15 min at 37° C. Cells were washed twice in RPMI+GlutaMAX I media and centrifuged at 400×g for 5 min. THP-1 target cells were resuspended at $5 \times 10^5$ cells/mL in RPMI media supplemented with 10% FCS HI. CFSE-labeled THP-1 cells and human pan T cells were mixed in a 10:1 effector to target ratio and seeded in a total volume of 100 µL/well in a 96-well assay plate (Greiner BioOne, #650185). Bispecific TrasKO2 molecules were added in 11 dilution series starting from 10 nM-0 nM (1:6 dilution) in a volume of 5 µL/well to the cells and incubated for 20 h at 37° C. and 5% CO2. After incubation, cells were stained with 5 µg/mL 7-AAD (Invitrogen, #A1310) for 30 min at 4° C. To determine cytotoxicity dead target cells were measured by gating on CFSE/7-AAD double positive THP-1 cells on a LSRII flow cytometer (BD) and EC50 values were determined with Xlfit software.

The dsTrasKO2 domain was evaluated as a replacement scaffold in a bispecific T cell engager antibody design. Bispecific T cell engagers were generated by using an anti-TCR α/β or one of two different anti-CD3ε as effector arms and an anti-CD123 as a target arm. Negative controls for both arms were generated by using TNP antibody sequences (tri-nitrophenol antibody). Bispecific proteins were purified by MabSelect Sure, followed by KappaSelect and SEC. Bispecific antibodies were expressed either as wild type bispecific IgG (detection of naturally occurring mispairing) or with TrasKO2 replacement on one of the Fab-arms (both possible re-engineered Fab-arms were produced). Biophysical characterization of the bispecific antibodies is described below in Table 12.

TABLE 12

Biophysical characterization of dsTrasKO2- T cell engager antibody constructs.

| | | | | | | MS | |
|---|---|---|---|---|---|---|---|
| Bispecific combination | ID | Yield [mg/L] | SEC [% monomer] | HIC [% monomer] | Correct paired LC1 + HC1 LC2 + HC2 [%] | Mispaired LC1 + HC1 LC1 + HC2 [%] | Mispaired LC2 + HC1 LC2 + HC2 [%] |
| anti-TCR α/β × anti-CD123 | 30 | 10.3 | 95.5 | 87.7 | 63.1 | 5.0 | 31.9 |
| anti-TCR α/β × anti-CD123 - dsTrasKO2 | 31 | 13.3 | 85.7 | 88.0 | 98.8 | | |
| anti-TCR α/β - dsTrasKO2 × anti-CD123 | 32 | 26.7 | 100.0 | 100.0 | 100.0 | | |
| anti-CD3ε × anti-CD123 | 33 | 25.7 | 100.0 | 87.7 | 79.7 | 8.3 | 12.0 |
| anti-CD3ε × anti-CD123-dsTrasKO2 | 34 | 19.0 | 93.1 | 89.1 | 100.0 | | |
| anti-CD3ε-dsTrasKO2 × anti-CD123 | 35 | 39.0 | 100.0 | 100.0 | 100.0 | | |
| anti-CD3ε × anti-CD123 | 36 | 40.7 | 100.0 | 100.0 | 77.4 | 14.7 | 7.9 |
| anti-CD3ε × anti-CD123-dsTrasKO2 | 37 | 35.7 | 100.0 | 100.0 | 100.0 | | |
| anti-CD3ε-dsTrasKO2 × anti-CD123 | 38 | 40.7 | 100.0 | 100.0 | 100.0 | | |

TABLE 12-continued

Biophysical characterization of dsTrasKO2- T cell engager antibody constructs.

| | | | | | | |
|---|---|---|---|---|---|---|
| anti-TCR α/β × anti-TNP | 39 | 34.0 | 92.3 | 94.9 | 45.0 | 55.0 |
| anti-TCR α/β × anti-TNP-dsTrasKO2 | 40 | 58.3 | 95.8 | 65.5 | 100.0 | |
| anti-TCR α/β-dsTrasKO2 × anti-TNP | 41 | 56.0 | 99.7 | 97.0 | 100.0 | |
| anti-TNP × anti-CD123 | 42 | 39.0 | 99.6 | 55.3 | 49.6 | 50.4 |
| anti-TNP × anti-CD123-dsTrasKO2 | 43 | 51.0 | 98.6 | 94.2 | 100.0 | |
| anti-TNP-dsTrasKO2 × anti-CD123 | 44 | 43.3 | 98.9 | 71.2 | 100.0 | |
| anti-CD3ε × anti-TNP | 45 | 64.0 | 99.0 | 69.8 | 69.0 | 31.0 |
| anti-CD3ε × anti-TNP-dsTrasKO2 | 46 | 19.7 | 98.2 | 63.5 | 100.0 | |
| anti-CD3ε-dsTrasKO2 × anti-TNP | 47 | 44.7 | 100.0 | 90.4 | 98.7 | |
| anti-CD3ε × anti-TNP | 48 | 95.0 | 100.0 | 100.0 | 88.2 | 1.6 | 10.2 |
| anti-CD3ε × anti-TNP-dsTrasKO2 | 49 | 56.7 | 100.0 | 67.3 | 100.0 | |
| anti-CD3ε-dsTrasKO2 × anti-TNP | 50 | 59.7 | 100.0 | 100.0 | 100.0 | |

| | DSF | | SPR | | | | Cytotox |
|---|---|---|---|---|---|---|---|
| ID | Tonset °C. | Tm1 °C. | KD(CD3) [M] | % Rmax (CD3) | KD(CD123) [M] | % Rmax (CD123) | EC50 [pM] |
| 30 | n.d. | n.d. | n.a. | n.a. | n.d. | n.d. | n.d. |
| 31 | n.d. | n.d. | n.a. | n.a. | n.d. | n.d. | n.d. |
| 32 | 58.5 | 63.6 | n.a. | n.a. | n.d. | n.d. | n.d. |
| 33 | 58.2 | 64.1 | 2.28E−07 | 33 | 2.12E−10 | 80 | 0.2 |
| 34 | n.d. | n.d. | 2.16E−07 | 33 | 2.39E−10 | 92 | 0.1 |
| 35 | 58.1 | 64.2 | 2.64E−07 | 35 | 2.57E−10 | 96 | 0.4 |
| 36 | 59.3 | 64.1 | 4.50E−08 | 19 | 3.52E−10 | 77 | 1.15 |
| 37 | 52.2 | 56.7 | 4.66E−08 | 21 | 3.86E−10 | 96 | 0.70 |
| 38 | 54.8 | 63.2 | 5.45E−08 | 25 | 3.32E−10 | 102 | 0.95 |
| 39 | 59.2 | 64.2 | n.a. | n.a. | n.a. | n.a. | n.a. |
| 40 | n.d. | 57.5 | n.a. | n.a. | n.a. | n.a. | n.a. |
| 41 | 58.4 | 62.8 | n.a. | n.a. | n.a. | n.a. | n.a. |
| 42 | 59.0 | 64.3 | n.a. | n.a. | 2.31E−10 | 94 | n.a. |
| 43 | 52.2 | 56.7 | n.a. | n.a. | 5.46E−10 | 87 | n.a. |
| 44 | 59.3 | 62.4 | n.a. | n.a. | 2.87E−10 | 97 | n.a. |
| 45 | 58.6 | 64.3 | 3.90E−07 | 34 | n.a. | n.a. | n.a. |
| 46 | 55.7 | 61.6 | 2.34E−07 | 33 | n.a. | n.a. | n.a. |
| 47 | 57.6 | 63.7 | 3.27E−07 | 32 | n.a. | n.a. | n.a. |
| 48 | 59.6 | 64.1 | 4.24E−08 | 18 | n.a. | n.a. | n.a. |
| 49 | n.d. | 61.6 | 3.86E−08 | 19 | n.a. | n.a. | n.a. |
| 50 | 60.3 | 64.8 | 4.33E−08 | 24 | n.a. | n.a. | n.a. |

Figure 15A:
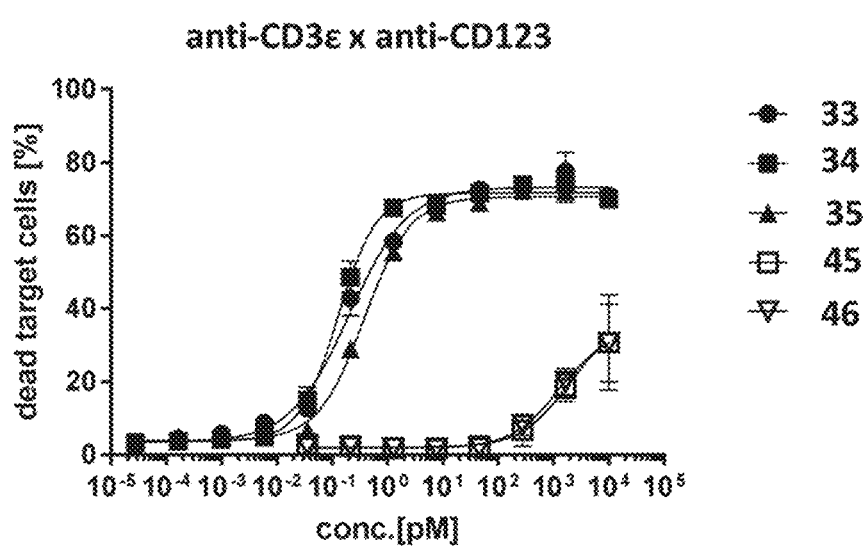
FIG. 15A-FIG. 15B depict cytotoxicity assays of human panT cells against THP-1 target cells co-incubated with bispecific antibodies anti-CD3ε×anti-CD123.
Figure 15B:
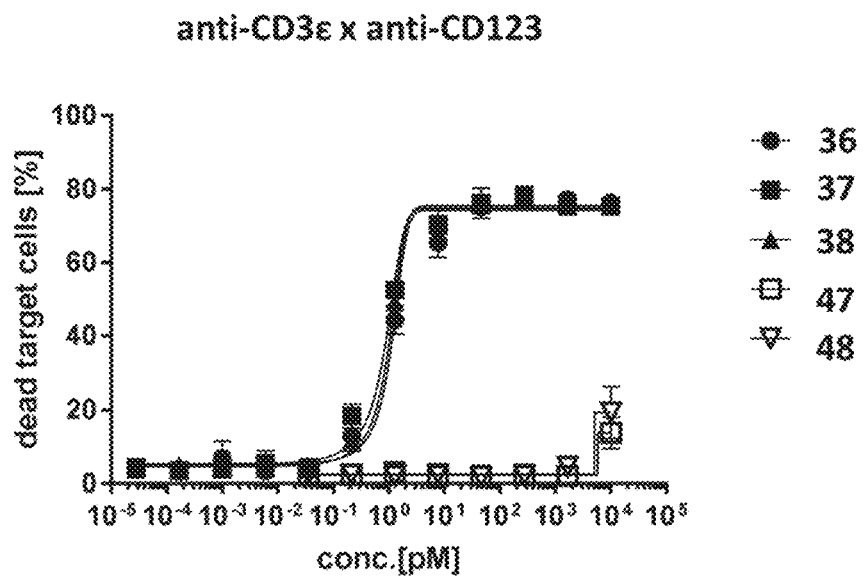

In addition to the above biophysical characterization, the bispecific TrasKO2 molecules were analyzed in cell-based cytotoxicity assays. As shown in FIG. 15A, all three anti-CD3ε×anti-CD123 bispecific antibodies demonstrated comparable and robust activity. The presence of the dsTrasKO2 domain in antibody ID number 34 and 35 did not negatively impact activity, while reducing chain mispairing. Negative controls antibody ID number 45 and 46, which contain TNP antibody sequences, were used. As shown in FIG. 15B, all three of the anti-CD3ε×anti-CD123 bispecific antibodies with an alternative anti-CD3ε binding domain demonstrated comparable and robust activity as well. The presence of the dsTrasKO2 domain in antibody ID number 37 and 38 did not negatively impact activity, while reducing chain mispairing. As negative controls, antibody ID number 47 and 48, which contain TNP antibody sequences, were used.

SEQUENCE LISTING (206 sequences)

SEQ ID NO: 1 - protein, 107 aa, Artificial Sequence [sequence omitted]

SEQ ID NO: 2 - protein, 120 aa, Artificial Sequence [sequence omitted]

SEQ ID NO: 3 - protein, 120 aa, Artificial Sequence
  source: /note="Description of Artificial Sequence: Synthetic polypeptide"
EVQLVESGGGLVQPGGSLRLSCAASGFNIKDTAIHWVRQAPGKGLEWVAEIYPTNGYTEYADSVKGRFTISADTSKNTAYLQMNSLRAEDTAVYYCSRWGGDGFAAMDYWGQGTLVTVSS

SEQ ID NO: 4 - protein, 120 aa, Artificial Sequence
  source: /note="Description of Artificial Sequence: Synthetic polypeptide"
EVQLVESGGGLVQPGGSLRLSCAASGFNIKDTYIHWVRQAPGKGLEWVAEIYPTNGYTEYADSVKGRFTISADTSKNTAYLQMNSLRAEDTAVYYCSRWGGDGFYAMDYWGQGTLVTVSS

SEQ ID NO: 5 - protein, 120 aa, Artificial Sequence
  source: /note="Description of Artificial Sequence: Synthetic polypeptide"
EVQLVESGGGLVQPGGSLRLSCAASGFNIKDTAIHWVRQAPGKGLEWVARIYPTNGYTRYADSVKGRFTISADTSKNTAYLQMNSLRAEDTAVYYCSRWGGDGFAAMDYWGQGTLVTVSS

SEQ ID NO: 6 - protein, 223 aa, Artificial Sequence
  source: /note="Description of Artificial Sequence: Synthetic polypeptide"
DIVLTQSPASLAVSLGQRATISCRASESVDSYGQSYMHWYQQKAGQPPKLLIYLASNLESGVPARFSGSGSRTDFTLTIDPVQAEDAATYYCQQNAEDSRTFGGGTKLEIKGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 7 - protein, 469 aa, Artificial Sequence
  source: /note="Description of Artificial Sequence: Synthetic polypeptide"
EVQLKESGPGLVAPGGSLSITCTVSGFSLTDSSINWVRQPPGKGLEWLGMIWGDGRIDYADALKSRLSISKDSSKSQVFLEMTSLRTDDTATYYCARDGYFPYAMDFWGQGTSVTVSSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 8 - protein, 228 aa, Artificial Sequence
  source: /note="Description of Artificial Sequence: Synthetic polypeptide"
DIVLTQSPASLAVSLGQRATISCRASESVDSYGQSYMHWYQQKAGQPPKLLIYLASNLESGVPARFSGSGSRTDFTLTIDPVQAEDAATYYCQQNAEDSRTFGGGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 9 - protein, 474 aa, Artificial Sequence
  source: /note="Description of Artificial Sequence: Synthetic polypeptide"
EVQLKESGPGLVAPGGSLSITCTVSGFSLTDSSINWVRQPPGKGLEWLGMIWGDGRIDYADALKSRLSISKDSSKSQVFLEMTSLRTDDTATYYCARDGYFPYAMDFWGQGTSVTVSSGGGGSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10 - protein, 218 aa, Artificial Sequence
  source: /note="Description of Artificial Sequence: Synthetic polypeptide"
DIVLTQSPASLAVSLGQRATISCRASESVDSYGQSYMHWYQQKAGQPPKLLIYLASNLESGVPARFSGSGSRTDFTLTIDPVQAEDAATYYCQQNAEDSRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - protein, 447 aa, Artificial Sequence
  source: /note="Description of Artificial Sequence: Synthetic polypeptide"
EVQLKESGPGLVAPGGSLSITCTVSGFSLTDSSINWVRQPPGKGLEWLGMIWGDGRIDYADALKSRLSISKDSSKSQVFLEMTSLRTDDTATYYCARDGYFPYAMDFWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 12 - protein, 219 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 13 - protein, 472 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 14 - protein, 224 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 15 - protein, 477 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 16 - protein, 214 aa, Artificial Sequence
  source: /note="Description of Artificial Sequence: Synthetic polypeptide"
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 450 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 18 - protein, 219 aa, Artificial Sequence
  source: /note="Description of Artificial Sequence: Synthetic polypeptide"
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 19 - protein, 470 aa, Artificial Sequence
  source: /note="Description of Artificial Sequence: Synthetic polypeptide"
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 20 - protein, 224 aa, Artificial Sequence
  source: /note="Description of Artificial Sequence: Synthetic polypeptide"
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 21 - protein, 475 aa, Artificial Sequence
  source: /note="Description of Artificial Sequence: Synthetic polypeptide"
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGGGSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 22 - protein, 214 aa, Artificial Sequence [sequence omitted]

SEQ ID NO: 23 - protein, 448 aa, Artificial Sequence
  source: /note="Description of Artificial Sequence: Synthetic polypeptide"
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 24 - protein, 220 aa, Artificial Sequence
  source: /note="Description of Artificial Sequence: Synthetic polypeptide"
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 25 - protein, 469 aa, Artificial Sequence
  source: /note="Description of Artificial Sequence: Synthetic polypeptide"
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 26 - protein, 225 aa, Artificial Sequence
  source: /note="Description of Artificial Sequence: Synthetic polypeptide"
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 27 - protein, 474 aa, Artificial Sequence
  source: /note="Description of Artificial Sequence: Synthetic polypeptide"
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGGSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 28 - protein, 215 aa, Artificial Sequence
  source: /note="Description of Artificial Sequence: Synthetic polypeptide"
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29 - protein, 447 aa, Artificial Sequence
  source: /note="Description of Artificial Sequence: Synthetic polypeptide"
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 30 - protein, 219 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 31 - protein, 464 aa, Artificial Sequence
  source: /note="Description of Artificial Sequence: Synthetic polypeptide"
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 32 - protein, 224 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 33 - protein, 469 aa, Artificial Sequence
  source: /note="Description of Artificial Sequence: Synthetic polypeptide"
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSGGGGSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 34 - protein, 214 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35 - protein, 442 aa, Artificial Sequence
  source: /note="Description of Artificial Sequence: Synthetic polypeptide"
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 36 - protein, 219 aa, Artificial Sequence
  source: /note="Description of Artificial Sequence: Synthetic polypeptide"
DIQMTQSPASLSVSVGDTITLTCHASQNIDVWLSWFQQKPGNIPKLLIYKASNLHTGVPSRFSGSGSGTGFTLTISSLQPEDIATYYCQQAHSYPFTFGGGTKLEIKGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 37 - protein, 474 aa, Artificial Sequence
  source: /note="Description of Artificial Sequence: Synthetic polypeptide"
QVQLQQSGPELVKPGASVKISCKASGYSFTSYWIHWIKQRPGQGLEWIGMIDPSDGETRLNQRFQGRATLTVDESTSTAYMQLRSPTSEDSAVYYCTRLKEYGNYDSFYFDVWGAGTLVTVSSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 38 - protein, 224 aa, Artificial Sequence
  source: /note="Description of Artificial Sequence: Synthetic polypeptide"
DIQMTQSPASLSVSVGDTITLTCHASQNIDVWLSWFQQKPGNIPKLLIYKASNLHTGVPSRFSGSGSGTGFTLTISSLQPEDIATYYCQQAHSYPFTFGGGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 39 - protein, 479 aa, Artificial Sequence
  source: /note="Description of Artificial Sequence: Synthetic polypeptide"
QVQLQQSGPELVKPGASVKISCKASGYSFTSYWIHWIKQRPGQGLEWIGMIDPSDGETRLNQRFQGRATLTVDESTSTAYMQLRSPTSEDSAVYYCTRLKEYGNYDSFYFDVWGAGTLVTVSSGGGGSGGGGSEVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 40 - protein, 214 aa, Artificial Sequence
  source: /note="Description of Artificial Sequence: Synthetic polypeptide"
DIQMTQSPASLSVSVGDTITLTCHASQNIDVWLSWFQQKPGNIPKLLIYKASNLHTGVPSRFSGSGSGTGFTLTISSLQPEDIATYYCQQAHSYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 452 aa, Artificial Sequence
  source: /note="Description of Artificial Sequence: Synthetic polypeptide"
QVQLQQSGPELVKPGASVKISCKASGYSFTSYWIHWIKQRPGQGLEWIGMIDPSDGETRLNQRFQGRATLTVDESTSTAYMQLRSPTSEDSAVYYCTRLKEYGNYDSFYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 42 - protein, 224 aa, Artificial Sequence; identical to SEQ ID NO: 32
  source: /note="Description of Artificial Sequence: Synthetic polypeptide"

SEQ ID NO: 43 - protein, 469 aa, Artificial Sequence
  source: /note="Description of Artificial Sequence: Synthetic polypeptide"
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 44 - protein, 225 aa, Artificial Sequence; identical to SEQ ID NO: 26
  source: /note="Description of Artificial Sequence: Synthetic polypeptide"

SEQ ID NO: 45 - protein, 474 aa, Artificial Sequence
  source: /note="Description of Artificial Sequence: Synthetic polypeptide"
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 46 - protein, 224 aa, Artificial Sequence; identical to SEQ ID NO: 38
  source: /note="Description of Artificial Sequence: Synthetic polypeptide"

SEQ ID NO: 47 - protein, 479 aa, Artificial Sequence
  source: /note="Description of Artificial Sequence: Synthetic polypeptide"
QVQLQQSGPELVKPGASVKISCKASGYSFTSYWIHWIKQRPGQGLEWIGMIDPSDGETRLNQRFQGRATLTVDESTSTAYMQLRSPTSEDSAVYYCTRLKEYGNYDSFYFDVWGAGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 48 - protein, 228 aa, Artificial Sequence; identical to SEQ ID NO: 8
  source: /note="Description of Artificial Sequence: Synthetic polypeptide"

SEQ ID NO: 49 - protein, 259 aa, Artificial Sequence
  source: /note="Description of Artificial Sequence: Synthetic polypeptide"
EVQLKESGPGLVAPGGSLSITCTVSGFSLTDSSINWVRQPPGKGLEWLGMIWGDGRIDYADALKSRLSISKDSSKSQVFLEMTSLRTDDTATYYCARDGYFPYAMDFWGQGTSVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTHHHHHH

SEQ ID NO: 50 - protein, 228 aa, Artificial Sequence; identical to SEQ ID NO: 8
  source: /note="Description of Artificial Sequence: Synthetic polypeptide"

SEQ ID NO: 51 - protein, 474 aa, Artificial Sequence
  source: /note="Description of Artificial Sequence: Synthetic polypeptide"
EVQLKESGPGLVAPGGSLSITCTVSGFSLTDSSINWVRQPPGKGLEWLGMIWGDGRIDYADALKSRLSISKDSSKSQVFLEMTSLRTDDTATYYCARDGYFPYAMDFWGQGTSVTVSSGGGGSGGGGSEVQLVESGGGLVQPGGSLRLSCAASGFNIKDTAIHWVRQAPGKCLEWVAEIYPTNGYTEYADSVKGRFTISADTSKNTAYLQMNSLRAEDTAVYYCSRWGGDGFAAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 52 - protein, 224 aa, Artificial Sequence; identical to SEQ ID NO: 38
  source: /note="Description of Artificial Sequence: Synthetic polypeptide"

SEQ ID NO: 53 - protein, 479 aa, Artificial Sequence
  source: /note="Description of Artificial Sequence: Synthetic polypeptide"
QVQLQQSGPELVKPGASVKISCKASGYSFTSYWIHWIKQRPGQGLEWIGMIDPSDGETRLNQRFQGRATLTVDESTSTAYMQLRSPTSEDSAVYYCTRLKEYGNYDSFYFDVWGAGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 54 - protein, 214 aa, Artificial Sequence; identical to SEQ ID NO: 34
  source: /note="Description of Artificial Sequence: Synthetic polypeptide"

SEQ ID NO: 55 - protein, 442 aa, Artificial Sequence
  source: /note="Description of Artificial Sequence: Synthetic polypeptide"
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 56 - protein, 228 aa, Artificial Sequence; identical to SEQ ID NO: 8
  source: /note="Description of Artificial Sequence: Synthetic polypeptide"

SEQ ID NO: 57 - protein, 474 aa, Artificial Sequence
  source: /note="Description of Artificial Sequence: Synthetic polypeptide"
EVQLKESGPGLVAPGGSLSITCTVSGFSLTDSSINWVRQPPGKGLEWLGMIWGDGRIDYADALKSRLSISKDSSKSQVFLEMTSLRTDDTATYYCARDGYFPYAMDFWGQGTSVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 58 - protein, 214 aa, Artificial Sequence; identical to SEQ ID NO: 34
  source: /note="Description of Artificial Sequence: Synthetic polypeptide"

SEQ ID NO: 59 - protein, 442 aa, Artificial Sequence; identical to SEQ ID NO: 55
  source: /note="Description of Artificial Sequence: Synthetic polypeptide"

SEQ ID NO: 60 - protein, 224 aa, Artificial Sequence; identical to SEQ ID NO: 32
  source: /note="Description of Artificial Sequence: Synthetic polypeptide"

SEQ ID NO: 61 - protein, 469 aa, Artificial Sequence
  source: /note="Description of Artificial Sequence: Synthetic polypeptide"
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 62 - protein, 218 aa, Artificial Sequence; identical to SEQ ID NO: 10
  source: /note="Description of Artificial Sequence: Synthetic polypeptide"

SEQ ID NO: 63 - protein, 447 aa, Artificial Sequence
  source: /note="Description of Artificial Sequence: Synthetic polypeptide"
EVQLKESGPGLVAPGGSLSITCTVSGFSLTDSSINWVRQPPGKGLEWLGMIWGDGRIDYADALKSRLSISKDSSKSQVFLEMTSLRTDDTATYYCARDGYFPYAMDFWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 64 - protein, 225 aa, Artificial Sequence; identical to SEQ ID NO: 26
  source: /note="Description of Artificial Sequence: Synthetic polypeptide"

SEQ ID NO: 65 - protein, 474 aa, Artificial Sequence
  source: /note="Description of Artificial Sequence: Synthetic polypeptide"
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 66 - protein, 214 aa, Artificial Sequence; identical to SEQ ID NO: 34
  source: /note="Description of Artificial Sequence: Synthetic polypeptide"

SEQ ID NO: 67 - protein, 442 aa, Artificial Sequence; identical to SEQ ID NO: 55
  source: /note="Description of Artificial Sequence: Synthetic polypeptide"

SEQ ID NO: 68 - protein, 224 aa, Artificial Sequence; identical to SEQ ID NO: 38
  source: /note="Description of Artificial Sequence: Synthetic polypeptide"

SEQ ID NO: 69 - protein, 479 aa, Artificial Sequence; identical to SEQ ID NO: 53
  source: /note="Description of Artificial Sequence: Synthetic polypeptide"

SEQ ID NO: 70 - protein, 218 aa, Artificial Sequence; identical to SEQ ID NO: 10
  source: /note="Description of Artificial Sequence: Synthetic polypeptide"

SEQ ID NO: 71 - protein, 447 aa, Artificial Sequence; identical to SEQ ID NO: 63
  source: /note="Description of Artificial Sequence: Synthetic polypeptide"

SEQ ID NO: 72 - protein, 224 aa, Artificial Sequence; identical to SEQ ID NO: 32
  source: /note="Description of Artificial Sequence: Synthetic polypeptide"

SEQ ID NO: 73 - protein, 469 aa, Artificial Sequence; identical to SEQ ID NO: 61
  source: /note="Description of Artificial Sequence: Synthetic polypeptide"

SEQ ID NO: 74 - protein, 214 aa, Artificial Sequence; identical to SEQ ID NO: 34
  source: /note="Description of Artificial Sequence: Synthetic polypeptide"

SEQ ID NO: 75 - protein, 442 aa, Artificial Sequence; identical to SEQ ID NO: 55
  source: /note="Description of Artificial Sequence: Synthetic polypeptide"

SEQ ID NO: 76 - protein, 107 aa, Artificial Sequence
  source: /note="Description of Artificial Sequence: Synthetic polypeptide"
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 77 - protein, 120 aa, Artificial Sequence
  source: /note="Description of Artificial Sequence: Synthetic polypeptide"
EVQLVESGGGLVQPGGSLRLSCAASGFNIKDTAIHWVRQAPGKCLEWVAEIYPTNGYTEYADSVKGRFTISADTSKNTAYLQMNSLRAEDTAVYYCSRWGGDGFAAMDYWGQGTLVTVSS

SEQ ID NO: 78 - protein, 120 aa, Artificial Sequence
  source: /note="Description of Artificial Sequence: Synthetic polypeptide"
EVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSS

SEQ ID NO: 79 - protein, 120 aa, Artificial Sequence
  source: /note="Description of Artificial Sequence: Synthetic polypeptide"
EVQLVESGGGLVQPGGSLRLSCAASGFNIKDTAIHWVRQAPGKCLEWVARIYPTNGYTRYADSVKGRFTISADTSKNTAYLQMNSLRAEDTAVYYCSRWGGDGFAAMDYWGQGTLVTVSS

SEQ ID NO: 80 - protein, 1331 aa, Artificial Sequence
  source: /note="Description of Artificial Sequence: Synthetic polypeptide"
QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 81 - protein, 1368 aa, Artificial Sequence
  source: /note="Description of Artificial Sequence: Synthetic polypeptide"
QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 82 - protein, 1368 aa, Artificial Sequence
  source: /note="Description of Artificial Sequence: Synthetic polypeptide"
QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIKEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 83 - protein, 1330 aa, Artificial Sequence
  source: /note="Description of Artificial Sequence: Synthetic polypeptide"
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 84 - protein, 1367 aa, Artificial Sequence
  source: /note="Description of Artificial Sequence: Synthetic polypeptide"
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 85 - protein, 1367 aa, Artificial Sequence
  source: /note="Description of Artificial Sequence: Synthetic polypeptide"
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIKDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 86 - protein, 1338 aa, Artificial Sequence
  source: /note="Description of Artificial Sequence: Synthetic polypeptide"
DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 87 - protein, 1375 aa, Artificial Sequence
  source: /note="Description of Artificial Sequence: Synthetic polypeptide"
DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 88 - protein, 1375 aa, Artificial Sequence
  source: /note="Description of Artificial Sequence: Synthetic polypeptide"
DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIKQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 89 - protein, 1331 aa, Artificial Sequence
  source: /note="Description of Artificial Sequence: Synthetic polypeptide"
QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 90 - protein, 1368 aa, Artificial Sequence
  source: /note="Description of Artificial Sequence: Synthetic polypeptide"
QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 91 - protein, 1368 aa, Artificial Sequence
  source: /note="Description of Artificial Sequence: Synthetic polypeptide"
QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIKEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 92 - protein, 1338 aa, Artificial Sequence
  source: /note="Description of Artificial Sequence: Synthetic polypeptide"
DVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 93 - protein, 1375 aa, Artificial Sequence
  source: /note="Description of Artificial Sequence: Synthetic polypeptide"
DVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 94 - protein, 1375 aa, Artificial Sequence
  source: /note="Description of Artificial Sequence: Synthetic polypeptide"
DVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIKQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 95 - protein, 1330 aa, Artificial Sequence
  source: /note="Description of Artificial Sequence: Synthetic polypeptide"
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 96 - protein, 1367 aa, Artificial Sequence
  source: /note="Description of Artificial Sequence: Synthetic polypeptide"
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 97 - protein, 1367 aa, Artificial Sequence
  source: /note="Description of Artificial Sequence: Synthetic polypeptide"
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIKDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 98 - protein, 1338 aa, Artificial Sequence
  source: /note="Description of Artificial Sequence: Synthetic polypeptide"
DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 99 - protein, 1375 aa, Artificial Sequence
  source: /note="Description of Artificial Sequence: Synthetic polypeptide"
DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 100 - protein, 1375 aa, Artificial Sequence
  source: /note="Description of Artificial Sequence: Synthetic polypeptide"
DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIKQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGQIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGDVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 101 - protein, 50 aa, Artificial Sequence
  source: /note="Description of Artificial Sequence: Synthetic polypeptide"
  SITE (1)..(50): /note="This sequence may encompass 1-10 'Gly Gly Gly Gly Ser' repeating units"
GGGGSGGGGSGGGGSGGGGSGGGGSGGGGSGGGGSGGGGSGGGGSGGGGS

SEQ ID NO: 102 - protein, 5 aa, Artificial Sequence
  source: /note="Description of Artificial Sequence: Synthetic peptide"
GGGGS

SEQ ID NO: 103 - protein, 10 aa, Artificial Sequence
  source: /note="Description of Artificial Sequence: Synthetic peptide"
GGGGSGGGGS

SEQ ID NO: 104 - protein, 4 aa, Artificial Sequence
  source: /note="Description of Artificial Sequence: Synthetic peptide"
GGGG

SEQ ID NO: 105 - protein, 5 aa, Artificial Sequence
  source: /note="Description of Artificial Sequence: Synthetic peptide"
GGGGG

SEQ ID NO: 106 - protein, 6 aa, Artificial Sequence
  source: /note="Description of Artificial Sequence: Synthetic peptide"
GGGGGG

SEQ ID NO: 107 - protein, 7 aa, Artificial Sequence
  source: /note="Description of Artificial Sequence: Synthetic peptide"
GGGGGGG

SEQ ID NO: 108 - protein, 8 aa, Artificial Sequence
  source: /note="Description of Artificial Sequence: Synthetic peptide"
GGGGGGGG

SEQ ID NO: 109 - protein, 4 aa, Artificial Sequence
  source: /note="Description of Artificial Sequence: Synthetic peptide"
GGGS

SEQ ID NO: 110 - protein, 15 aa, Artificial Sequence
  source: /note="Description of Artificial Sequence: Synthetic peptide"
GGGGSGGGGSGGGGS

SEQ ID NO: 111 - protein, 10 aa, Artificial Sequence
  source: /note="Description of Artificial Sequence: Synthetic peptide"
GGSGSSGSGG

SEQ ID NO: 112 - protein, 5 aa, Artificial Sequence
  source: /note="Description of Artificial Sequence: Synthetic peptide"
TKGPS

SEQ ID NO: 113 - protein, 5 aa, Artificial Sequence
  source: /note="Description of Artificial Sequence: Synthetic peptide"
TVAAP

SEQ ID NO: 114 - protein, 5 aa, Artificial Sequence
  source: /note="Description of Artificial Sequence: Synthetic peptide"
QPKAA

SEQ ID NO: 115 - protein, 5 aa, Artificial Sequence
  source: /note="Description of Artificial Sequence: Synthetic peptide"
QRIEG

SEQ ID NO: 116 - protein, 7 aa, Artificial Sequence
  source: /note="Description of Artificial Sequence: Synthetic peptide"
ASTKGPS

SEQ ID NO: 117 - protein, 7 aa, Artificial Sequence
  source: /note="Description of Artificial Sequence: Synthetic peptide"
RTVAAPS

SEQ ID NO: 118 - protein, 7 aa, Artificial Sequence
  source: /note="Description of Artificial Sequence: Synthetic peptide"
GQPKAAP

SEQ ID NO: 119 - protein, 7 aa, Artificial Sequence
  source: /note="Description of Artificial Sequence: Synthetic peptide"
HIDSPNK

SEQ ID NO: 120 - protein, 5 aa, Artificial Sequence
  source: /note="Description of Artificial Sequence: Synthetic peptide"
DKTHT

SEQ ID NO: 121 - protein, 6 aa, Artificial Sequence
  source: /note="Description of Artificial Sequence: Synthetic peptide"
TKGPSR

SEQ ID NO: 122 - protein, 25 aa, Artificial Sequence
  source: /note="Description of Artificial Sequence: Synthetic peptide"
  SITE (1)..(25): /note="This sequence may encompass 0-5 'Gly Gly Gly Gly Ser' repeating units"
GGGGSGGGGSGGGGSGGGGSGGGGS

SEQ ID NO: 123 - protein, 213 aa, Artificial Sequence
  source: /note="Description of Artificial Sequence: Synthetic polypeptide"
QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 124 - protein, 213 aa, Artificial Sequence; identical to SEQ ID NO: 123
  source: /note="Description of Artificial Sequence: Synthetic polypeptide"

SEQ ID NO: 125 - protein, 223 aa, Artificial Sequence
  source: /note="Description of Artificial Sequence: Synthetic polypeptide"
QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 126 - protein, 213 aa, Artificial Sequence
  source: /note="Description of Artificial Sequence: Synthetic polypeptide"
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 127 - protein, 213 aa, Artificial Sequence; identical to SEQ ID NO: 126
  source: /note="Description of Artificial Sequence: Synthetic polypeptide"

SEQ ID NO: 128 - protein, 223 aa, Artificial Sequence
  source: /note="Description of Artificial Sequence: Synthetic polypeptide"
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 129 - protein, 219 aa, Artificial Sequence
  source: /note="Description of Artificial Sequence: Synthetic polypeptide"
DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 130 - protein, 219 aa, Artificial Sequence; identical to SEQ ID NO: 129
  source: /note="Description of Artificial Sequence: Synthetic polypeptide"

SEQ ID NO: 131 - protein, 229 aa, Artificial Sequence
  source: /note="Description of Artificial Sequence: Synthetic polypeptide"
DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 132 - protein, 213 aa, Artificial Sequence; identical to SEQ ID NO: 123
  source: /note="Description of Artificial Sequence: Synthetic polypeptide"

SEQ ID NO: 133 - protein, 213 aa, Artificial Sequence; identical to SEQ ID NO: 123
  source: /note="Description of Artificial Sequence: Synthetic polypeptide"

SEQ ID NO: 134 - protein, 223 aa, Artificial Sequence; identical to SEQ ID NO: 125
  source: /note="Description of Artificial Sequence: Synthetic polypeptide"

SEQ ID NO: 135 - protein, 219 aa, Artificial Sequence
  source: /note="Description of Artificial Sequence: Synthetic polypeptide"
DVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 136 - protein, 219 aa, Artificial Sequence; identical to SEQ ID NO: 135
  source: /note="Description of Artificial Sequence: Synthetic polypeptide"

SEQ ID NO: 137 - protein, 229 aa, Artificial Sequence
  source: /note="Description of Artificial Sequence: Synthetic polypeptide"
DVVMTQSPLSLPVTLGQPASISCRSSQSLVHSIGNTYLHWYQQRPGQSPRLLIYKVSNRFSGVPDRFSGSGSGTDFTLKISRVEAEDVGVYYCSQSTHVPFTFGQGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 138 - protein, 213 aa, Artificial Sequence; identical to SEQ ID NO: 126
  source: /note="Description of Artificial Sequence: Synthetic polypeptide"

SEQ ID NO: 139 - protein, 213 aa, Artificial Sequence; identical to SEQ ID NO: 126
  source: /note="Description of Artificial Sequence: Synthetic polypeptide"

SEQ ID NO: 140 - protein, 223 aa, Artificial Sequence; identical to SEQ ID NO: 128
  source: /note="Description of Artificial Sequence: Synthetic polypeptide"

SEQ ID NO: 141 - protein, 219 aa, Artificial Sequence; identical to SEQ ID NO: 129
  source: /note="Description of Artificial Sequence: Synthetic polypeptide"

SEQ ID NO: 142 - protein, 219 aa, Artificial Sequence; identical to SEQ ID NO: 129
  source: /note="Description of Artificial Sequence: Synthetic polypeptide"

SEQ ID NO: 143 - protein, 229 aa, Artificial Sequence; identical to SEQ ID NO: 131
  source: /note="Description of Artificial Sequence: Synthetic polypeptide"

SEQ ID NO: 144 - protein, 449 aa, Artificial Sequence
  source: /note="Description of Artificial Sequence: Synthetic polypeptide"
EVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 145 - protein, 449 aa, Artificial Sequence; identical to SEQ ID NO: 144
  source: /note="Description of Artificial Sequence: Synthetic polypeptide"

SEQ ID NO: 146 - protein, 476 aa, Artificial Sequence
  source: /note="Description of Artificial Sequence: Synthetic polypeptide"
EVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 147 - protein, 448 aa, Artificial Sequence
  source: /note="Description of Artificial Sequence: Synthetic polypeptide"
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 148 - protein, 448 aa, Artificial Sequence; identical to SEQ ID NO: 147
  source: /note="Description of Artificial Sequence: Synthetic polypeptide"

SEQ ID NO: 149 - protein, 475 aa, Artificial Sequence
  source: /note="Description of Artificial Sequence: Synthetic polypeptide"
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 150 - protein, 450 aa, Artificial Sequence
  source: /note="Description of Artificial Sequence: Synthetic polypeptide"
QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 151 - protein, 450 aa, Artificial Sequence; identical to SEQ ID NO: 150
  source: /note="Description of Artificial Sequence: Synthetic polypeptide"

SEQ ID NO: 152 - protein, 477 aa, Artificial Sequence
  source: /note="Description of Artificial Sequence: Synthetic polypeptide"
QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 153 - protein, 449 aa, Artificial Sequence; identical to SEQ ID NO: 144
  source: /note="Description of Artificial Sequence: Synthetic polypeptide"

SEQ ID NO: 154 - protein, 449 aa, Artificial Sequence; identical to SEQ ID NO: 144
  source: /note="Description of Artificial Sequence: Synthetic polypeptide"

SEQ ID NO: 155 - protein, 476 aa, Artificial Sequence; identical to SEQ ID NO: 146
  source: /note="Description of Artificial Sequence: Synthetic polypeptide"

SEQ ID NO: 156 - protein, 450 aa, Artificial Sequence
  source: /note="Description of Artificial Sequence: Synthetic polypeptide"
QIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 157 - protein, 450 aa, Artificial Sequence; identical to SEQ ID NO: 156
  source: /note="Description of Artificial Sequence: Synthetic polypeptide"

SEQ ID NO: 158 - protein, 477 aa, Artificial Sequence
  source: /note="Description of Artificial Sequence: Synthetic polypeptide"
QIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 159 - protein, 448 aa, Artificial Sequence; identical to SEQ ID NO: 147
  source: /note="Description of Artificial Sequence: Synthetic polypeptide"

SEQ ID NO: 160 - protein, 448 aa, Artificial Sequence; identical to SEQ ID NO: 147
  source: /note="Description of Artificial Sequence: Synthetic polypeptide"

SEQ ID NO: 161 - protein, 475 aa, Artificial Sequence; identical to SEQ ID NO: 149
  source: /note="Description of Artificial Sequence: Synthetic polypeptide"

SEQ ID NO: 162 - protein, 450 aa, Artificial Sequence; identical to SEQ ID NO: 150
  source: /note="Description of Artificial Sequence: Synthetic polypeptide"

SEQ ID NO: 163 - protein, 450 aa, Artificial Sequence; identical to SEQ ID NO: 150
  source: /note="Description of Artificial Sequence: Synthetic polypeptide"

SEQ ID NO: 164 - protein, 477 aa, Artificial Sequence; identical to SEQ ID NO: 152
  source: /note="Description of Artificial Sequence: Synthetic polypeptide"

SEQ ID NO: 165 - protein, 449 aa, Artificial Sequence
  source: /note="Description of Artificial Sequence: Synthetic polypeptide"
EVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 166 - protein, 476 aa, Artificial Sequence
  source: /note="Description of Artificial Sequence: Synthetic polypeptide"
EVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 167 - protein, 449 aa, Artificial Sequence; identical to SEQ ID NO: 165
  source: /note="Description of Artificial Sequence: Synthetic polypeptide"

SEQ ID NO: 168 - protein, 449 aa, Artificial Sequence; identical to SEQ ID NO: 165
  source: /note="Description of Artificial Sequence: Synthetic polypeptide"

SEQ ID NO: 169 - protein, 476 aa, Artificial Sequence; identical to SEQ ID NO: 166
  source: /note="Description of Artificial Sequence: Synthetic polypeptide"

SEQ ID NO: 170 - protein, 449 aa, Artificial Sequence; identical to SEQ ID NO: 165
  source: /note="Description of Artificial Sequence: Synthetic polypeptide"

SEQ ID NO: 171 - protein, 449 aa, Artificial Sequence; identical to SEQ ID NO: 165
  source: /note="Description of Artificial Sequence: Synthetic polypeptide"

SEQ ID NO: 172 - protein, 476 aa, Artificial Sequence; identical to SEQ ID NO: 166
  source: /note="Description of Artificial Sequence: Synthetic polypeptide"

SEQ ID NO: 173 - protein, 449 aa, Artificial Sequence; identical to SEQ ID NO: 165
  source: /note="Description of Artificial Sequence: Synthetic polypeptide"

SEQ ID NO: 174 - protein, 450 aa, Artificial Sequence
  source: /note="Description of Artificial Sequence: Synthetic polypeptide"
QIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 175 - protein, 477 aa, Artificial Sequence
  source: /note="Description of Artificial Sequence: Synthetic polypeptide"
QIQLVQSGSELKKPGASVKVSCKASGYTFTNYGMNWVRQAPGQGLEWVGWINTYTGGPKYAQGFTGRFVFSVDTSVSTAYLQISSLKAEDTAVYYCARGIYDGYHWYFDVWGRGTLVTVSSGGGGSGGGGSEVQLVESGGGLVQPGGSLRLSCAASGFNIKDTYIHWVRQAPGKCLEWVAEIYPTNGYTEYADSVKGRFTISADTSKNTAYLQMNSLRAEDTAVYYCSRWGGDGFYAMDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 176 - protein, 450 aa, Artificial Sequence; identical to SEQ ID NO: 174
  source: /note="Description of Artificial Sequence: Synthetic polypeptide"

SEQ ID NO: 177 - protein, 449 aa, Artificial Sequence; identical to SEQ ID NO: 165
  source: /note="Description of Artificial Sequence: Synthetic polypeptide"

SEQ ID NO: 178 - protein, 476 aa, Artificial Sequence; identical to SEQ ID NO: 166
  source: /note="Description of Artificial Sequence: Synthetic polypeptide"

SEQ ID NO: 179 - protein, 449 aa, Artificial Sequence; identical to SEQ ID NO: 165
  source: /note="Description of Artificial Sequence: Synthetic polypeptide"

SEQ ID NO: 180 - protein, 450 aa, Artificial Sequence; identical to SEQ ID NO: 174
  source: /note="Description of Artificial Sequence: Synthetic polypeptide"

SEQ ID NO: 181 - protein, 477 aa, Artificial Sequence; identical to SEQ ID NO: 175
  source: /note="Description of Artificial Sequence: Synthetic polypeptide"

SEQ ID NO: 182 - protein, 450 aa, Artificial Sequence; identical to SEQ ID NO: 174
  source: /note="Description of Artificial Sequence: Synthetic polypeptide"

SEQ ID NO: 183 - protein, 450 aa, Artificial Sequence; identical to SEQ ID NO: 174
  source: /note="Description of Artificial Sequence: Synthetic polypeptide"

SEQ ID NO: 184 - protein, 477 aa, Artificial Sequence; identical to SEQ ID NO: 175
  source: /note="Description of Artificial Sequence: Synthetic polypeptide"

SEQ ID NO: 185 - protein, 450 aa, Artificial Sequence; identical to SEQ ID NO: 174
  source: /note="Description of Artificial Sequence: Synthetic polypeptide"

SEQ ID NO: 186 - protein, 220 aa, Artificial Sequence
  source: /note="Description of Artificial Sequence: Synthetic polypeptide"
DFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 187 - protein, 230 aa, Artificial Sequence
  source: /note="Description of Artificial Sequence: Synthetic polypeptide"
DFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIK

SEQ ID NO: 188 - protein, 220 aa, Artificial Sequence; identical to SEQ ID NO: 186
  source: /note="Description of Artificial Sequence: Synthetic polypeptide"

SEQ ID NO: 189 - protein, 220 aa, Artificial Sequence; identical to SEQ ID NO: 186
  source: /note="Description of Artificial Sequence: Synthetic polypeptide"

SEQ ID NO: 190 - protein, 230 aa, Artificial Sequence; identical to SEQ ID NO: 187
  source: /note="Description of Artificial Sequence: Synthetic polypeptide"

SEQ ID NO: 191 - protein, 220 aa, Artificial Sequence; identical to SEQ ID NO: 186
  source: /note="Description of Artificial Sequence: Synthetic polypeptide"

SEQ ID NO: 192 - protein, 220 aa, Artificial Sequence; identical to SEQ ID NO: 186
  source: /note="Description of Artificial Sequence: Synthetic polypeptide"

SEQ ID NO: 193 - protein, 230 aa, Artificial Sequence; identical to SEQ ID NO: 187
  source: /note="Description of Artificial Sequence: Synthetic polypeptide"

SEQ ID NO: 194 - protein, 220 aa, Artificial Sequence; identical to SEQ ID NO: 186
  source: /note="Description of Artificial Sequence: Synthetic polypeptide"

SEQ ID NO: 195 - protein, 219 aa, Artificial Sequence; identical to SEQ ID NO: 135
  source: /note="Description of Artificial Sequence: Synthetic polypeptide"

SEQ ID NO: 196 - protein, 229 aa, Artificial Sequence; identical to SEQ ID NO: 137
  source: /note="Description of Artificial Sequence: Synthetic polypeptide"

SEQ ID NO: 197 - protein, 219 aa, Artificial Sequence; identical to SEQ ID NO: 135
  source: /note="Description of Artificial Sequence: Synthetic polypeptide"

SEQ ID NO: 198 - protein, 220 aa, Artificial Sequence; identical to SEQ ID NO: 186
  source: /note="Description of Artificial Sequence: Synthetic polypeptide"

SEQ ID NO: 199 - protein, 230 aa, Artificial Sequence; identical to SEQ ID NO: 187
  source: /note="Description of Artificial Sequence: Synthetic polypeptide"

SEQ ID NO: 200 - protein, 220 aa, Artificial Sequence; identical to SEQ ID NO: 186
  source: /note="Description of Artificial Sequence: Synthetic polypeptide"

SEQ ID NO: 201 - protein, 219 aa, Artificial Sequence; identical to SEQ ID NO: 135
  source: /note="Description of Artificial Sequence: Synthetic polypeptide"

SEQ ID NO: 202 - protein, 229 aa, Artificial Sequence; identical to SEQ ID NO: 137
  source: /note="Description of Artificial Sequence: Synthetic polypeptide"

SEQ ID NO: 203 - protein, 219 aa, Artificial Sequence; identical to SEQ ID NO: 135
  source: /note="Description of Artificial Sequence: Synthetic polypeptide"

SEQ ID NO: 204 - protein, 219 aa, Artificial Sequence; identical to SEQ ID NO: 135
  source: /note="Description of Artificial Sequence: Synthetic polypeptide"

SEQ ID NO: 205 - protein, 229 aa, Artificial Sequence; identical to SEQ ID NO: 137
  source: /note="Description of Artificial Sequence: Synthetic polypeptide"

SEQ ID NO: 206 - protein, 219 aa, Artificial Sequence; identical to SEQ ID NO: 135
  source: /note="Description of Artificial Sequence: Synthetic polypeptide"

The invention claimed is:

1. A binding protein comprising:
   at least one pseudoFab portion comprising
   (1) a first VL domain (VLa) paired with a first VH domain (VHa) to form a first functional antigen binding site that binds target antigen A; and
   (2) a first stabilized knockout VH domain (VHX) paired with a first stabilized knockout VL domain (VLX) to form a first stabilized knockout domain, wherein the VLX/VHX pair is selected from the group consisting of:
   (i) VLX comprising an amino acid sequence of SEQ ID NO: 76 and VHX comprising an amino acid sequence of SEQ ID NO: 77;
   ii) VLX comprising an amino acid sequence of SEQ ID NO: 76 and VHX comprising an amino acid sequence of SEQ ID NO: 78; and
   iii) VLX comprising an amino acid sequence of SEQ ID NO: 76 and VHX comprising an amino acid sequence of SEQ ID NO: 79.

2. A binding protein comprising:
   at least one pseudoFab portion comprising
   (1) a first VL domain (VLa) paired with a first VH domain (VHa) to form a first functional antigen binding site that binds target antigen A; and
   (2) a first stabilized knockout VH domain (VHX) paired with a first stabilized knockout VL domain (VLX) to form a first stabilized knockout domain, wherein:
   (a) the VHX comprises one or more inactivating mutations of Y33A, R50E, R59E, and Y105A as set forth in SEQ ID NO: 2, and a cysteine substitution of G44C as set forth in SEQ ID NO: 2; and
   (b) the VLX comprises a cysteine substitution of Q100C as set forth in SEQ ID NO: 1.

3. A binding protein comprising:
   at least one pseudoFab portion comprising
   (1) a first VL domain (VLa) paired with a first VH domain (VHa) to form a first functional antigen binding site that binds target antigen A; and
   (2) a first stabilized knockout VH domain (VHX) paired with a first stabilized knockout VL domain (VLX) to form a first stabilized knockout domain, wherein:
   (a) the VHX comprises a cysteine substitution of G44C as set forth in SEQ ID NO: 3; and
   (b) the VLX comprises a cysteine substitution of Q100C as set forth in SEQ ID NO: 1.

4. A binding protein comprising:
   at least one pseudoFab portion comprising
   (1) a first VL domain (VLa) paired with a first VH domain (VHa) to form a first functional antigen binding site that binds target antigen A; and
   (2) a first stabilized knockout VH domain (VHX) paired with a first stabilized knockout VL domain (VLX) to form a first stabilized knockout domain, wherein:
   (a) the VHX comprises a cysteine substitution of G44C as set forth in SEQ ID NO: 4; and
   (b) the VLX comprises a cysteine substitution of Q100C as set forth in SEQ ID NO: 1.

5. A binding protein comprising:
   at least one pseudoFab portion comprising
   (1) a first VL domain (VLa) paired with a first VH domain (VHa) to form a first functional antigen binding site that binds target antigen A; and
   (2) a first stabilized knockout VH domain (VHX) paired with a first stabilized knockout VL domain (VLX) to form a first stabilized knockout domain, wherein:
   (a) the VHX comprises a cysteine substitution of G44C as set forth in SEQ ID NO: 5; and
   (b) the VLX comprises a cysteine substitution of Q100C as set forth in SEQ ID NO: 1.

6. A binding protein comprising:
   at least one pseudoFab portion comprising
   (1) a first VL domain (VLa) paired with a first VH domain (VHa) to form a first functional antigen binding site that binds target antigen A; and
   (2) a first stabilized knockout VH domain (VHX) paired with a first stabilized knockout VL domain (VLX) to form a first stabilized knockout domain, wherein the VLX/VHX pair is selected from the group consisting of:
   (i) a VLX comprising an amino acid sequence that is at least 85% identical to SEQ ID NO: 76, and comprising a cysteine substitution of Q100C, and
   a VHX comprising an amino acid sequence that is at least 85% identical to SEQ ID NO: 77, and comprising amino acid substitutions Y33A, R50E, R59E, and Y105A and a cysteine substitution of G44C;
   ii) a VLX comprising an amino acid sequence that is at least 85% identical to SEQ ID NO: 76, and comprising a cysteine substitution of Q100C, and
   a VHX comprising an amino acid sequence that is at least 85% identical to SEQ ID NO: 78, and comprising amino acid substitutions R50E and R59E and a cysteine substitution of G44C; and
   iii) a VLX comprising an amino acid sequence that is at least 85% identical to SEQ ID NO: 76, and comprising a cysteine substitution of Q100C, and
   a VHX comprising an amino acid sequence that is at least 85% identical to SEQ ID NO: 79, and comprising amino acid substitutions Y33A and Y105A and a cysteine substitution of G44C.

7. The binding protein of claim 1, wherein the binding protein comprises separate proteins chains selected from one of the following groups:
   (a) VHa-CH1-L1-VHb-L2-VHX and VLa-CL and VLb-L3-VLX;
   (b) VHa-L2-VHX-L1-VHb-CH1 and VLa-L3-VLX and VLb-CL;
   (c) VHa-CH1-L1-VHa-CH1 and VHb-L2-VHX-L3-VHb-L4-VHX and two chains VLb-L5-VLX and two chains VLa-CL;
   wherein the chains of (a) and (b) can be present once or twice, and
   wherein L1, L2, L3, L4 and L5 are linkers, which are independently the same or different.

8. The binding protein of claim 1, wherein the binding domain comprises independently one or two first pseudoFab portion(s) and one or two first Fab portion(s).

9. The binding protein of claim 1, wherein:
   (1) the first pseudoFab portion comprises a first polypeptide chain having a structure represented by the formula:

N-VHa-L1-VHX-C     (Ia)

and a second polypeptide chain having a structure represented by the formula:

N-VLa-L2-VLX-C     (IIa)

wherein L1 and L2 are linkers, which can independently be present or absent, and wherein N and C represent the N- and C-terminal ends, respectively;

(2) the first pseudoFab portion comprises of a first polypeptide chain having a structure represented by the formula:

N-VHX-L1-VHa-C (Ib)

and a second polypeptide chain having a structure represented by the formula:

N-VLX-L2-VLa-C (IIb)

wherein L1 and L2 are linkers, which can independently be present or absent, and wherein N and C represent the N- and C-terminal ends, respectively;

(3) the first pseudoFab portion comprises of a first polypeptide chain having a structure represented by the formula:

N-VLa-L1-VHX-C (Ic)

and a second polypeptide chain having a structure represented by the formula:

N-VHa-L2-VLX-C (IIc)

wherein L1 and L2 are linkers, which can independently be present or absent, and wherein N and C represent the N- and C-terminal ends, respectively; or (4) the first pseudoFab portion comprises of a first polypeptide chain having a structure represented by the formula:

N-VHX-L1-VLa-C (Id)

and a second polypeptide chain having a structure represented by the formula:

N-VLX-L2-VHa-C (IId)

wherein L1 and L2 are linkers, which can independently be present or absent, and wherein N and C represent the N- and C-terminal ends, respectively.

10. The binding protein claim 1, further comprising one or more additional binding domains operably linked to an N- or C-terminus of the binding protein.

11. The binding protein claim 1, wherein the one or more additional binding domains are operably linked to N-terminus of the first or second pseudoFab portion.

12. The binding protein of claim 2, wherein the binding protein comprises separate proteins chains selected from one of the following groups:
(a) VHa-CH1-L1-VHb-L2-VHX and VLa-CL and VLb-L3-VLX;
(b) VHa-L2-VHX-L1-VHb-CH1 and VLa-L3-VLX and VLb-CL;
(c) VHa-CH1-L1-VHa-CH1 and VHb-L2-VHX-L3-VHb-L4-VHX and two chains VLb-L5-VLX and two chains VLa-CL;
wherein the chains of (a) and (b) can be present once or twice, and
wherein L1, L2, L3, L4 and L5 are linkers, which are independently the same or different.

13. The binding protein of claim 2, wherein the binding domain comprises independently one or two first pseudoFab portion(s) and one or two first Fab portion(s).

14. The binding protein of claim 2, wherein:
(1) the first pseudoFab portion comprises a first polypeptide chain having a structure represented by the formula:

N-VHa-L1-VHX-C (Ia)

and a second polypeptide chain having a structure represented by the formula:

N-VLa-L2-VLX-C (IIa)

wherein L1 and L2 are linkers, which can independently be present or absent, and wherein N and C represent the N- and C-terminal ends, respectively;

(2) the first pseudoFab portion comprises of a first polypeptide chain having a structure represented by the formula:

N-VHX-L1-VHa-C (Ib)

and a second polypeptide chain having a structure represented by the formula:

N-VLX-L2-VLa-C (IIb)

wherein L1 and L2 are linkers, which can independently be present or absent, and wherein N and C represent the N- and C-terminal ends, respectively;

(3) the first pseudoFab portion comprises of a first polypeptide chain having a structure represented by the formula:

N-VLa-L1-VHX-C (Ic)

and a second polypeptide chain having a structure represented by the formula:

N-VHa-L2-VLX-C (IIc)

wherein L1 and L2 are linkers, which can independently be present or absent, and wherein N and C represent the N- and C-terminal ends, respectively; or (4) the first pseudoFab portion comprises of a first polypeptide chain having a structure represented by the formula:

N-VHX-L1-VLa-C (Id)

and a second polypeptide chain having a structure represented by the formula:

N-VLX-L2-VHa-C (IId)

wherein L1 and L2 are linkers, which can independently be present or absent, and wherein N and C represent the N- and C-terminal ends, respectively.

15. The binding protein claim 2, further comprising one or more additional binding domains operably linked to an N- or C-terminus of the binding protein.

16. The binding protein claim 2, wherein the one or more additional binding domains are operably linked to N-terminus of the first or second pseudoFab portion.

17. The binding protein of claim 3, wherein the binding protein comprises separate proteins chains selected from one of the following groups:
(a) VHa-CH1-L1-VHb-L2-VHX and VLa-CL and VLb-L3-VLX;
(b) VHa-L2-VHX-L1-VHb-CH1 and VLa-L3-VLX and VLb-CL;
(c) VHa-CH1-L1-VHa-CH1 and VHb-L2-VHX-L3-VHb-L4-VHX and two chains VLb-L5-VLX and two chains VLa-CL;
wherein the chains of (a) and (b) can be present once or twice, and
wherein L1, L2, L3, L4 and L5 are linkers, which are independently the same or different.

18. The binding protein of claim 3, wherein the binding domain comprises independently one or two first pseudoFab portion(s) and one or two first Fab portion(s).

19. The binding protein of claim 3, wherein:
(1) the first pseudoFab portion comprises a first polypeptide chain having a structure represented by the formula:

N-VHa-L1-VHX-C (Ia)

and a second polypeptide chain having a structure represented by the formula:

N-VLa-L2-VLX-C (IIa)

wherein L1 and L2 are linkers, which can independently be present or absent, and wherein N and C represent the N- and C-terminal ends, respectively;

(2) the first pseudoFab portion comprises of a first polypeptide chain having a structure represented by the formula:

N-VHX-L1-VHa-C (Ib)

and a second polypeptide chain having a structure represented by the formula:

N-VLX-L2-VLa-C (IIb)

wherein L1 and L2 are linkers, which can independently be present or absent, and wherein N and C represent the N- and C-terminal ends, respectively;

(3) the first pseudoFab portion comprises of a first polypeptide chain having a structure represented by the formula:

N-VLa-L1-VHX-C (Ic)

and a second polypeptide chain having a structure represented by the formula:

N-VHa-L2-VLX-C (IIc)

wherein L1 and L2 are linkers, which can independently be present or absent, and wherein N and C represent the N- and C-terminal ends, respectively; or (4) the first pseudoFab portion comprises of a first polypeptide chain having a structure represented by the formula:

N-VHX-L1-VLa-C (Id)

and a second polypeptide chain having a structure represented by the formula:

N-VLX-L2-VHa-C (IId)

wherein L1 and L2 are linkers, which can independently be present or absent, and wherein N and C represent the N- and C-terminal ends, respectively.

20. The binding protein claim 3, further comprising one or more additional binding domains operably linked to an N- or C-terminus of the binding protein.

21. The binding protein claim 3, wherein the one or more additional binding domains are operably linked to N-terminus of the first or second pseudoFab portion.

22. The binding protein of claim 4, wherein the binding protein comprises separate proteins chains selected from one of the following groups:
(a) VHa-CH1-L1-VHb-L2-VHX and VLa-CL and VLb-L3-VLX;
(b) VHa-L2-VHX-L1-VHb-CH1 and VLa-L3-VLX and VLb-CL;
(c) VHa-CH1-L1-VHa-CH1 and VHb-L2-VHX-L3-VHb-L4-VHX and two chains VLb-L5-VLX and two chains VLa-CL;
wherein the chains of (a) and (b) can be present once or twice, and
wherein L1, L2, L3, L4 and L5 are linkers, which are independently the same or different.

23. The binding protein of claim 4, wherein the binding domain comprises independently one or two first pseudoFab portion(s) and one or two first Fab portion(s).

24. The binding protein of claim 4, wherein:
(1) the first pseudoFab portion comprises a first polypeptide chain having a structure represented by the formula:

N-VHa-L1-VHX-C (Ia)

and a second polypeptide chain having a structure represented by the formula:

N-VLa-L2-VLX-C (IIa)

wherein L1 and L2 are linkers, which can independently be present or absent, and wherein N and C represent the N- and C-terminal ends, respectively;

(2) the first pseudoFab portion comprises of a first polypeptide chain having a structure represented by the formula:

N-VHX-L1-VHa-C (Ib)

and a second polypeptide chain having a structure represented by the formula:

N-VLX-L2-VLa-C (IIb)

wherein L1 and L2 are linkers, which can independently be present or absent, and wherein N and C represent the N- and C-terminal ends, respectively;

(3) the first pseudoFab portion comprises of a first polypeptide chain having a structure represented by the formula:

N-VLa-L1-VHX-C (Ic)

and a second polypeptide chain having a structure represented by the formula:

N-VHa-L2-VLX-C (IIc)

wherein L1 and L2 are linkers, which can independently be present or absent, and wherein N and C represent the N- and C-terminal ends, respectively; or (4) the first pseudoFab portion comprises of a first polypeptide chain having a structure represented by the formula:

N-VHX-L1-VLa-C (Id)

and a second polypeptide chain having a structure represented by the formula:

N-VLX-L2-VHa-C (IId)

wherein L1 and L2 are linkers, which can independently be present or absent, and wherein N and C represent the N- and C-terminal ends, respectively.

25. The binding protein claim 4, further comprising one or more additional binding domains operably linked to an N- or C-terminus of the binding protein.

26. The binding protein claim 4, wherein the one or more additional binding domains are operably linked to N-terminus of the first or second pseudoFab portion.

27. The binding protein of claim 5, wherein the binding protein comprises separate proteins chains selected from one of the following groups:
(a) VHa-CH1-L1-VHb-L2-VHX and VLa-CL and VLb-L3-VLX;
(b) VHa-L2-VHX-L1-VHb-CH1 and VLa-L3-VLX and VLb-CL;
(c) VHa-CH1-L1-VHa-CH1 and VHb-L2-VHX-L3-VHb-L4-VHX and two chains VLb-L5-VLX and two chains VLa-CL;
wherein the chains of (a) and (b) can be present once or twice, and
wherein L1, L2, L3, L4 and L5 are linkers, which are independently the same or different.

28. The binding protein of claim 5, wherein the binding domain comprises independently one or two first pseudoFab portion(s) and one or two first Fab portion(s).

29. The binding protein of claim 5, wherein:
(1) the first pseudoFab portion comprises a first polypeptide chain having a structure represented by the formula:

N-VHa-L1-VHX-C    (Ia)

and a second polypeptide chain having a structure represented by the formula:

N-VLa-L2-VLX-C    (IIa)

wherein L1 and L2 are linkers, which can independently be present or absent, and wherein N and C represent the N- and C-terminal ends, respectively;

(2) the first pseudoFab portion comprises of a first polypeptide chain having a structure represented by the formula:

N-VHX-L1-VHa-C    (Ib)

and a second polypeptide chain having a structure represented by the formula:

N-VLX-L2-VLa-C    (IIb)

wherein L1 and L2 are linkers, which can independently be present or absent, and wherein N and C represent the N- and C-terminal ends, respectively;

(3) the first pseudoFab portion comprises of a first polypeptide chain having a structure represented by the formula:

N-VLa-L1-VHX-C    (Ic)

and a second polypeptide chain having a structure represented by the formula:

N-VHa-L2-VLX-C    (IIc)

wherein L1 and L2 are linkers, which can independently be present or absent, and wherein N and C represent the N- and C-terminal ends, respectively; or (4) the first pseudoFab portion comprises of a first polypeptide chain having a structure represented by the formula:

N-VHX-L1-VLa-C    (Id)

and a second polypeptide chain having a structure represented by the formula:

N-VLX-L2-VHa-C    (IId)

wherein L1 and L2 are linkers, which can independently be present or absent, and wherein N and C represent the N- and C-terminal ends, respectively.

30. The binding protein claim 5, further comprising one or more additional binding domains operably linked to an N- or C-terminus of the binding protein.

31. The binding protein claim 5, wherein the one or more additional binding domains are operably linked to N-terminus of the first or second pseudoFab portion.

32. The binding protein of claim 6, wherein the binding protein comprises separate proteins chains selected from one of the following groups:
(a) VHa-CH1-L1-VHb-L2-VHX and VLa-CL and VLb-L3-VLX;
(b) VHa-L2-VHX-L1-VHb-CH1 and VLa-L3-VLX and VLb-CL;
(c) VHa-CH1-L1-VHa-CH1 and VHb-L2-VHX-L3-VHb-L4-VHX and two chains VLb-L5-VLX and two chains VLa-CL;

wherein the chains of (a) and (b) can be present once or twice, and wherein L1, L2, L3, L4 and L5 are linkers, which are independently the same or different.

33. The binding protein of claim 6, wherein the binding domain comprises independently one or two first pseudoFab portion(s) and one or two first Fab portion(s).

34. The binding protein of claim 6, wherein:
(1) the first pseudoFab portion comprises a first polypeptide chain having a structure represented by the formula:

N-VHa-L1-VHX-C    (Ia)

and a second polypeptide chain having a structure represented by the formula:

N-VLa-L2-VLX-C    (IIa)

wherein L1 and L2 are linkers, which can independently be present or absent, and wherein N and C represent the N- and C-terminal ends, respectively;

(2) the first pseudoFab portion comprises of a first polypeptide chain having a structure represented by the formula:

N-VHX-L1-VHa-C    (Ib)

and a second polypeptide chain having a structure represented by the formula:

N-VLX-L2-VLa-C    (IIb)

wherein L1 and L2 are linkers, which can independently be present or absent, and wherein N and C represent the N- and C-terminal ends, respectively;

(3) the first pseudoFab portion comprises of a first polypeptide chain having a structure represented by the formula:

N-VLa-L1-VHX-C    (Ic)

and a second polypeptide chain having a structure represented by the formula:

N-VHa-L2-VLX-C    (IIc)

wherein L1 and L2 are linkers, which can independently be present or absent, and wherein N and C represent the N- and C-terminal ends, respectively; or (4) the first pseudoFab portion comprises of a first polypeptide chain having a structure represented by the formula:

N-VHX-L1-VLa-C    (Id)

and a second polypeptide chain having a structure represented by the formula:

N-VLX-L2-VHa-C    (IId)

wherein L1 and L2 are linkers, which can independently be present or absent, and wherein N and C represent the N- and C-terminal ends, respectively.

35. The binding protein claim 6, further comprising one or more additional binding domains operably linked to an N- or C-terminus of the binding protein.

36. The binding protein claim 6, wherein the one or more additional binding domains are operably linked to N-terminus of the first or second pseudoFab portion.

* * * * *

UNITED STATES PATENT AND TRADEMARK OFFICE
CERTIFICATE OF CORRECTION

| | |
|---|---|
| PATENT NO. | : 11,739,160 B2 |
| APPLICATION NO. | : 16/725224 |
| DATED | : August 29, 2023 |
| INVENTOR(S) | : Beil et al. |

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 345 days.

Signed and Sealed this
First Day of July, 2025

Coke Morgan Stewart
*Acting Director of the United States Patent and Trademark Office*